United States Patent 11,602,550 (COMPOSITIONS COMPRISING BACTERIAL STRAINS AND USE THEREOF IN CONTROLLING PATHOGENIC MICROORGANISMS) - sequence listing, part 5

SEQ ID NO: 8 - DNA, 4089095 bp, Bacillus subtilis (residues 1-2,044,548 of 4,089,095)
tttttcataaaaaagactcctttctccatcagctgcaatgacattgtctgtgggattttttagaaatcttttagcctcttttccggctattaaaccttttattttgctgatcataggttttccaatcatttacttgtatttttttcaatgtcactgaaacattttacctgctgcggcgtccaatataaggtgattcagcacatcatcattatcaattttcaaaaacaagaacttataaatataggaatatttatcgaaaaatgtctttcgaggagttgccccatggcaaatagaatggtacgcttcaaatattaaagaaacgtgaggtattgatatatggaagaacgatcacagcgcagaaagaaaaaaagaaaactaaaaaaatgggtgaaagttgttgccgtttaatggctttctagtcattgcggcaggctctgtcggcgcctacgcttttgtaaagctgaacaatgcttctaaggaagctcacgtcagtcttgcacgcggagaaacaatccgtaaaacggatcaaagaatttgatcctggaaaagattcattttctgtattgctcttaggaattgatgccagggagaaaaacggcgagaccgtcgatcaggcaagaagtgacgcgaatgtgctggttacatttaatcggaaagaaaaaacagctaaaaatgctgagcattccgcgtgatgcctatgtaaacatcccaggccacggtatgataaattcacacatgctcacgcttacggcggcgttgacttaactgtgaaaacagttgaagaaatgctggatattccagtcgattatgtcgtagaaagcaatttcacggcttttgaagacgtcgtaaacgagttaaatggcgtcaagtaacggtaaaaagcgataaagtcattcagcaaatcaaaaaagatacaaaaggtaaagtcgttcttcaaaaaggaacacatacttgatggtgaagaagcgctcgcttacgtaagaacacgtaaagcggacagtgaccttttacgcgggcaaagacaaatggaagtgctgagcgccattatagataaatcaaaaatcattgagctcaattccggcttatgatgatattgtggatacgatggggcaaaatttaaaaatgaacttatctcttaaagatgccatcggcctgttcccgttcatcacttcattgaaatcagttgagtctattcagctgacgggttatgattatgaacctgccggagtctattatttcaaattgaatcagcaaaagctgcaggaagttaaagaagagctgcaaaacgatttaggtgtataatgaacgggatggcgattacgccatcccgttttacatatttccttattgaaaattatcaaagtaacgattagccttaatttatatggattatgttcacaggcaagctgaacatactacacgaagcagcttcatttttaaggaggttcccctacatatgaaatgtattgcgattgatctagacggaacattactgaataaagaaagcgtcatttctgcggaaaacagagaggcgatcaagcgggccgttgatgccggcatcctcgtcaccatttgcacgggaagagcgacatttgatgtaaaagcgctgctgaatgacttggacatccctatcattgcagctaatggcggcacgatccatgacacgggttaccgtttgatcagccggacattaatggatcaggaagccggtaaagcgattgctgattacttactttcaaaaaacatttattttgaggtatatacagatgaccatctgctttctccttttgacggcgaagctaagctgcacgcggagcttgacattctaaagagcgcaaatccaaacgagcagacggatgaattgtggcaaggagccatgactcaattcaaacagtttggcattaaaccaatccctcatatcgaatcggtttttgacggcggtgaaaacatttataagcttctttgcttctcctttgatatggacaagctgaaacaagcgaaggaagaactgaagcatcataaaaaactggcgcaaacctcttcaggaaaacatattatcgaaatcctgccggcctcatcaggaaaaggacgcgcgttaacaaagctggctgacatatacggaattgaaacacaggatatctatgcgatcggcgatagtccaaacgatttgtccatgtttgaagtcgccggccaccgtatcgccatggaaaatgcgattgatgaattaaaagaaaaaagcacctttgtcacaaaaaagcaatgacgaaaatggtgtggcctactttatagaccagcttctttcagggcaatatgcataaagaaaagactccagagattggagtctttttcttttattgcacccgtatacttcctgcgtatttatccttccaatatgtgctcgtgttcatattggtgatggtcacgccgtttgataatgtgacatgaacaacttgtccgtttccgatatagatggagggatttaagcttgttgattgaaagaacacaatgtctcccggcttcagggccgccttctcaatcttagttccggcattgtactggcttgttgcgtatcgaggcagtgaaataccagctgctttctggtagacatattggacaaatccagctgtatcaaatcctgtctcaggtgttactccgccctgtttgtaaggcacttctccgacataaagcgtcgcttcggaaacaatcggattttctttcgggattgtcaggttgtcaaatcggcgaatacccgtcatcttcgatttccagtaatcctctgacaaatacgaaatggttactttttctgaccggcttgcctgaatgaacctgcctgcgcccgcataaatgcctgcatgtgaaattcccgttttatacgtattgctgaaatagacgacatcaccaggctttatgttctgaggggctacctctcgcccactgcccactgctgttcggctgatcgcggcagataaatgccgagtgcctgttgaaacacatattgcacaagccccgagcaatcaaagccctctgacggcgtgcttccgccaaacacatatgggacaccgatatatttttcagcctcctgtacgacaggaacatcagccgttgccggatcggcagcgattcgtctcgccccgatataagttccgctccaatagctgctttttttgtaattggtgatgataaccccttttgactgtgtactgtgaaccatttggccgtctccgatataaagggcgtcatgtgtcggaacagtaccggtgcttccctctttcttgaaaaacaaaatatcacccggcttcaggttttccggctttacagctgttccgattttatactggtcgtttacagatctcggcagatgaatatcagccttactgaacacatattgtatcaatcctgatggatcgaaaccctctttcggcgtttccccgccatatttatactgatatccaagcaggtttttgcttcgctgacaatcaattctgatgatgtatcagcttccgcaatctccgcttttgtcataattggaaccaaaaaacaaatgataaccgccacaagcaaaaacttcttccagtttgccagtgtgttcacttttattatctcctcctctttttgcagttttaacatcggtatttttttgaatatgttaagagactttttgatatttttacagaatgaatatgctgggcaaataaaaagagagtgtctcatcagacactctcttttttgaattatttattggcgtttaccggttcttcctgctgttggattttattcatttccatatcaatcttctgtttttcctgatctgtcagctgatcattgaatttaaaagctgacataaacatgaacacgatggctacggcaacaaatggccagatggctttgacaaatttcatctttatcactccgtttatttagattttagtttgtcactatgatcaatatcaaacgtcagttttccgtcttctactttccaagcgaaattagagtctttcgtcagttcgcgaataatggttttctgtttaaggctgtcttttttcacaggtgcaggtgtcgcttcatggatgtcgatcggtgtcacttcaaagcgtcctgttccatttttcttcaggtgatactgaaccagtgcactgtctcttgttctcgtccagccttggtcaaagacaaagttgccgaggctgtagaaaatgacggttccgttatatacttcaatcggttctaagacgtgcggatgatggccgacgatgatgtcagctcccgcatcagacatggctcttgcaagctggcgctggcggtcgtttggatcattgtcatactcttgaccccagtgtgactgcacaacaacaatgtccgcatgttttttcgcttctgaaatcatagggatgaagatttcaggatctgcgggcagcacgcccggcgtattctttttagccgcgaaacctttcccggacacatcggtaaagccaagcgtcgcaatcgttaccccgttgactttctggtacgaaattttctttttcgcatcacttaagctgtatcccgctccaacgatatcaaggttttgcttcgcaaattctccaagtgtatctttcatgccctgaacgccgtaatccattgcgtggttgttggcgctgttgagaactgtgaaattcatgtccttcaagacttttactgattccttattcgtctgcagatgaatctttttatctgcttgtttataattcttttgataggttaccgggttttcaaagtttcctgctacataatccgaagctctaaagatcggttcaacatattgaaaaatactgtctgcccctttttgctccgttactttttcaacatagcgtcccatcataatatcgcctacaaatgaggctgagagtacgtcgtcagaatacgttttgaccttcggcgtttccgcttttcccgcccacatgaaagcgaacataaggacaaaaacgatcggaatggcaataaatacgtgcttattggttttcttttttgctgttttgtcagctttagcagcttttcatgaaagctcagttcttttttcatcgtttgacacaccttacattaaattaagtagtaaacaaacatgattgcaaaggtcgctccgctcaatagcagcgtgcttccgaacgtaatggttaaaccttgtttctgaatggtattggcaattaaacctggcacgatgatgccgattcctctaaattctgcgatttcaaatggtacaatcgggtatagaaaatcaaatgcgattttcagtacgatccctgttatcagcatggcagcgaattttctgcgtccgtacaaaatcataaatttggataaaccgtatttcacaatgacatacgtgagcaagctcactagcaaaacaagtaaaataaagaccggctgattaaacacaagtcctaaatatcccggtacaacaagtcctgccggcacgatccctgtttttccgcaaaaattaaactgagtagtacacctaaaattagtgcgatgtataaatctgatccgaacatgtctgcatttcccctagcttacgagctgctttaccttgtattcgtggattttttcaattaaaggctctgcggcaccatgaatattgccgacgccatatatgacacggttgtgcattcttttctttaacaattccataatttcatctgttgacttatactctagatcatgcagtttgtctgcaggaattttgccttcttcgtaggcttttacgatcggttctgttgtttcaccgattaagatcagttcacttgcttcaatataaggcaatacgtcatttgcgaattgctgtgtccgatcgacacggtctgcgcggcagttcatgatgatgatcggatcatcggtcgggtaaccgatttcttttacacgtttccatatattcaaagtagaagaagcgtcgtttgcggcaaacccattaacaaagtgcccaggctcgctcggactgatcagcggaagaattctcattgctcccggatctggcggcgcattcagcattcccttaaatgctgtttcttcgtcaatgccgagtgcttgagccacacccagcgccagagaagcgttatcagggaataccatgtattcaaatttacgtaaatattcatctgtaatttttgagttatcagcaatgatgacttttgtgtttcgttcttttgctttttgtttaaagaactcggtatattcactatctgtaatgacaagatggccattataaggaattgtagcggtaaacgcttctgcaatttcatcaagcgtcggccccatgacatccatatggtcttctaaaacattcacaatgacgccgatattggcctgcagaagttcttcctgaaagatgatttgataatctgggttaacagccatgcattcactgacaatcgcgttagcccctctttctactgtttctctcatgacttctttttgctctccgatattcggcccctgaggtttccgtttaatcggcttttcctccggtgtgtcccagtaaatcattcttgcatctgttcctgttgtttttccaacagtcttgtaaccggcttctattaatattccggttgtcagccttgtcacagtcgattttccgcggatgccgttaatattcacccgaacagggagggcatcaatgtttttctgatgtcgtcgtttttctaatattccgatgaccagtatgacagcacaggctataatgagtaaccacattgcttttcgacatctccttctatattgttgtaaattcattcatcagtatatagaatcactatgaattctcaatcggcattatgtaacataatcttccctaatcgactaagccaaacttctcttttgaaagagattttatacctacaaactgttttctatttttggaaaacagcaggacttacaccttatcactttttttaaaaatcgaagagaatgcgctttcatttttctcctgatatccttctggacgtatagtcacaccccgctgtttgtatttaatatgcatttcaaatcaatctttttttcagcctgtgttatcaagcatctcctgctatcatgcgtgtttccggttcttatgaacacaaaatagttttatcctgtttcttaaggacaaggtcataatgtcatcctttctgcatggaagcggcaatattaggcccattccaaaatgactaatgggaccagccatgaaaacgctaaacatacgagtccgaattctctaacataattaaacattttctgggatgatagtcttttctgtttctcaccatttacaggtctaaacgcatgactttgaaacaattttaataaaacttaatatttgttcaagaaatcttcatccatatttgtgaagactttgtcaaaaaagagtgaaaaccttaaatttttcaattatatatacaatttacaagtagatttcttttgatatttttattgctaacttcggattgttcatgataatctatctatgtaaacggttacataaacaaggaggagctgttttggctacaattaaagatgtcgccggagcggcgggcgtttcagttgcgacggtttcccgcgtcctgaatgataacggctatgtacacgaagaaacgcgaacgcgtgtcatagcggcgatggcgaagctgaactattacccgaacgaagtcgccagatctctatataaaagagaatcccgactgatcggacttttgctcccggatatcacaaaccctttcttcccccagcttgcccgcggtgcggaggatgaattgaaccgggaaggctatcgccttattttcggcaacagtgacgaggaattgaaaaaagaacttgaataccttcaaacctttaagcaaaatcatgtcgcaggcattattgccgcaacaaattacccggatctcgaggaatacagcggcatgaattatccagttgtttttctggacagaacacttgaaggggctccttctgtgtccagtgacggctatacaggaggaaagttagccgctcaggctatcattcacgggaaaagccagcgcattacgctcttgagaggacccgctcacctgccgaccgctcaagatcgctttaacggtgctttggaaatcttaaagcaggctgaagttgattttcaggtcattgagacggcttcattttcaattaaagatgcacaatcgatggcgaaggagctgtttgccgcttatccagcgacagatggtgtgatcgcgagtaatgatattcaagccgctgccgttttacatgaagcattgcggcgcggaaaaaacgtgccggaggacattcaaattatcggctatgatgacattccgcaaagcggacttctgttcccgccactttctacaattaaacagcccgcatatgatatggggagagaagctgccaaactgcttttggtatcatcaaaaaacagccgctggcagaaacggcaattcaaatgcctgtcacctatataggaagaaagacgacaagaaaggaagattaagatgcgtaatatttgtgtgattggtagctgttctatggatttagtggtcacctcggacagacgcccaaaagccggtgaaacggttcttggcacgtcatttcagactgtgccgggcggcaaaggagcaaatcaggccgttgccgcagctagacttggggcgcaagtgtttatggtcggcaaggtcggagacgatcattatggaacagctattttgaataatctcaaagctaacggcgtttgcactgactatatggaaccggttacacatacagaaagcggaaccgctcatattgtgcttgctgaaggcgacaacagcattgtcgttgtcaaaggcgcgaacgatgacatcaccccagcgtatgcgttaaacgcgctcgaacagattgaaaaggtcgatatggtgctgattcagcaggaaatcccagaagaaacggttgatgaggtgtgcaaatactgccattctcacgatatcccgatcatgctaaacccagcaccggcccgcccgctcaagcaggaaacaattgatcacgctacctatctgacgccgaatgaacacgaggcttcgattttattccctgatcttaccatttctgaagctctggcgctttatccggcaaagctctttattacggaaggaaaacaaggcgtccgctattcggctggcagcaaagaggtgctcatcccgtccttccctgtagagcccgttgatacaaccggagccggtgatacgtttaacgcagcctttgccgtggccctggctgagggaaaagacattgaagccgcattgcggtttgccaatcgtgccgcttccctttctgtctgctccttcggtgcccaaggcggaatgccgacaagaaataaagtagaggagctgctgtcatgaaaaaacacggtatactgaacagccatcttgccaagattttagccgaccttggccacactgataaaattgtcatcgcggatgccggactgccggttcctgacggcgttttgaaaattgatctttcactgaagccggccttccggctttccaagatacagcggcagtgctcgctgacgagatggtcatcgaaaaagtcattgctgcagctgacataaaagcatccaatcaggagaatgcgaaatttctagaaaatcttttctctgaacaagagattgaatacctttctcacgaggagtttaagctgctgacaaaagaagcaaaggcagtaataagaacaggagaattcacaccatatgccaactgcatcctgcaggcaggtgtgcttttctagaaaggaggatgaaacatgcagattgaaatgaaagacattcataaagcattcggaaaaaatcaggtgctgtcaggcgtttcctttcagctcatgcctggcgaggttcacgcattaatgggagaaaacggcgccggcaagtccacgcttatgaacattttgacaggcctgcacaaagcagataaaggtcaaatcagcataaacggaaacgaaacgtatttttccaatccgaaagaagcggaacagcatggaatagcctttatccatcaggaattgaatatctggccggaaatgaccgttcttgagaatctatttatcggtaaagagatatcctccaagctgggcgtcttacaaacaagaaaaatgaaagcgctagcaaaggagcagtttgacaaactctccgtctctctttctcttgatcaagaagccggcgaatgttcggtcggacagcagcaaatgatcgaaatcgcaaaagcgcttatgacaaatgccgaggtcatcattatggatgaaccgaccgcagcgttgactgaacgtgaaatcagcaagctctttgaggtcattacagcgttaaaaaagaacggcgtctccattgtctatatttcgcatcgcatggaagaaatttttgcgatttgcgacagaattaccatcatgcgtgacggaaaaacggtagatacaacaaacatctcagaaactgattttgatgaagtcgtcaaaaaaatggtcggacgggagctgactgaacgatatccaaaacgcactccttctctcggtgacaaagtattcgaggtgaaaaatgcctccgtaaaagggagttttgaggatgtcagcttctatgtgcgttccggtgagatcgtcggtgtttcaggattaatgggagccggccggacagaaatgatgagagcgctgttcggcgttgacaggctggacacgggtgagatatggatcgctgggaaaaaaacggctattaagaacccgcaggaagccgtgaaaaaaggtctcggctttattacagagaatcgcaaggatgaagggctcctgctcgacacctcgatccgcgaaaatattgccctgcccaatctgtccagcttctcaccaaagggtctcattgatcataagcgggaggctgaatttgtcgatctgttaatcaaacgcctcactatcaaaacagcatcaccggaaacgcacgcacgccatttatcaggaggaaaccagcaaaaagtggtgatagccaagtggatcggcatcggaccgaaagtgcttatcttggatgagccaaccagaggtgtggatgttggcgccaaacgagagatttatacgctgatgaatgagctgaccgaacgcggcgtcgctatcatcatggtgtcatcagagctgcctgaaattctgggaatgagcgatcggattatcgttgtccatgaaggcagaatcagcggagaaatccatgcgcgagaagcaacacaagaacgaattatgacacttgccacgggagggcggtaatatgaaaacggaacaactgcaaacagaacaaaaacggattcacttcgacggagtcatgcaaaaactcggcccgtttcttggtttatttattctcgttatcattgtatctattttaaatcccagctttcttgaaccgctgaatattttaaacctgcttcgccaggtcgccattaacggattaatcgcgttcgggatgacctttgtcattttgacaggcggcattgatctttctgtcggcgctattcttgccctgtccagtgctttagttgcggggatgattgtgtccggtgtcgatccggttctcgcgatcatccttggctgtatcattggtgccgtactaggcatgatcaacggattattgattactaaaggaaaaatggcgccctttatcgccacgcttgcgaccatgactgtgtttcgcggactgacgctagtgtatacagatggaaatccgattaccggacttggcacaaactacgcttttcagatgttcggacgcggttactttttaggcattcctgtaccggcgattacgatggttcttgcctttgtcatcctttgggtgcttcttcataaaacaccattcggacgccggacgtacgcaatcggcggcaacgagaaagccgcgctcatttcaggcatcaaagtgacgcgcgtgaaagtgatgatctattctttagccgggcttttatccgctcttgcaggtgccatattgacttcccgcctgcattcggcccagccgactgcgggggaatcgtacgaacttgatgctatcgcggcagtcgtcttaggcgggacaagtctttctggcggccgaggacgcattgtcggcacgttaatcggggtactgatcatcggcacacttaataacgggcttaatctgcttggcgtctcatcattttatcagctggttgtcaaagggattgttatcttgattgcggtattattagaccgcaagaagtcagcttaggagggttttcacatgaaaaaggctgtatccgtcattttaacgttatcattatttttgttaaccgcctgttcgcttgagcctccccaatgggcaaagccgtcaaactcggggaacaaaaaggaattcaccattggcttgtccgtctcaacacttaataatcctttttttgtctcattaaaaaagggtatcgaaaaagaagctaaaaaacggggaatgaaagtcatcattgttgatgcacaaaatgattcatcgaaacagacgagtgacgtggaagatttaattcagcaaggtgttgatgcattattaatcaacccgactgattcttcggcgatctcaacggcagtagaatctgcaaacgcagtcggtgtgcccgtcgtaacaatcgatcgatctgccgaacaaggaaaagttgaaaccctcgttgcttccgataatgtaaaaggcggtgaaatggccgcggcgtttattgccgacaaacttggaaaaggagcaaaggtggcagagcttgaaggcgtccccggcgcatctgccacacgggaacgcggctcaggattccataacatcgcagaccaaaagctccatgttgtcacaaaacaatcagctgactttgaccgcacgaaaggcctgactgtcatggaaaacctgctgcagggacatcctgatatccaagctgtttttgctcacaacgatgaaatggcgctcggtgctctcgaggcaattaacagctcggggaaagacatattggtgattggttttgacggcaataaagatgcgctcgcttccattaaagacggaaagctgtcagccaccgtcgctcagcagcctgaattaatcggtaaattggctacagaagcagcagatgatattttgcacggaaaaaaagtgcaaaaaacaatatccgcgcctctcaaactagaaacacaaaaataattgtctgatgtttaggaacctgcgataacgtgaatagagatatagaatgaattatttctcttacgtgaggagaggaacggcatgaacaaaccaacaaaactattttcaacattagcacttgcggctggaatgactgcggctgctgctggcggcgctggaacgatccatgcccaacagccagaaacaacggtaagcattgatgatttatacagttatccgattgattcttatttggtatcagcagaggctctaaatgtcagaacgaagccttccgcatcaagccagaaagccgatacgctgcacctaggagatagcttaaagctgatttccttctcaaatgctgactgggcaaaggttcagtataaaaacggaaaaataggatttgtctccactcattacattgtaaaagcagcgacaacggtaaaaaccaaaacaaaaacaaaagtatatacttccgctgatggaaagagcattaagactcttccagcagacacaagcgtttcttttttaggctggagtaaaacgaataaaggcggttttgattttgattgggtattcgttgattacggcggtgcgacaggttatatgaaaacaaaggatttacacatgacaaaataactgagagggattccgcatttatgcggaatcccttttattatgaattgatttgtcacattcccaagatatttctcaggaaatattgtcgtatgctgtgtcgaaaccttacatgatcatcgacatttttgttcacgctaaaaagcggaggtgtaaatatggatcaatttgaagcagcatatgaatcgtataaagcccggcaaacaactgtcgatcaagaaaatgttccatctggaaaagaagaaattattgcggttagaagaaatgaggaagacaatattatcgcagtgaaaaccaatacaggaagagagctcgactaccctactgcgctgtcagaagcaaaatcaggaaaactcgctcatgttgatgtcttccataaatacgggcgtgacattttgcgaagtgaaccggacggcatcaaggaaaataacctgtctgagctgccggatttttaaacaaatacagccctgccgtatgttggacagggctgtattttaaacaaaaggctgctggatgtattcggctaaccgttttgcactgtgagaaatatcctctgcagctgcataattcacgccatagaacacatatggaggcagatacttcatgccgatcagattactcgtggcctgaaatggtttcaatagctcactgatcgagtaatgatttgctccgcccgcttgatatttttccgcttcgctccctgttgatacagccagtatcagctccttgccatgcaaggcatttccttctgaaccaaaagcccagccgtaagtcagcacaagatcctgccattttttcaagagcggcggagagctgtaccaatatagcgggaattgaaagacaatccgatcgtattcctcgcacagctgctgttccttcgcaacatctatttcttcatccgggtattccttataaagatcccgtactgtgatattgtcatgtttactcaattcctcagcccacgccttattgacaactgaggtctccatatgaggatgaactgccaaaaccaatattttcatcagaccacacctttactgttttgatgttattttatctaaaatcaggaaaagagccaaataaaaagaaagccctgtaaaaggggctttctttttttcttttattcagggcttccttctgttgtttcgatatctttcgcaaaatcagggttatccagattcgcattaaagaaatccgctgtgttcggaagtctgagattcatgttcattttttgagaaatcgtaaccgtgcaatcctcaagcacatagtcaaaaacgtgtccgcctgaattgcgtccttcgtcaatgaagtgcaggtgatagcctgaaacggcgattccgtttgcataagctggtgtcaagaaacctacgattgttcctctcacgttgtcgaagttgaaaatcggctgtgttttgaccgcttcaaccattggcacgtaaggtttttcttgaagttctacggttcttgtctgcacctttttaaacaatccgtcaatacgaattgcataaaataagtttctgcttggcagcatgctgttgatctctttttcaaagtcttcgcgtgtcattttcgcatcaattttgtgcgtcatgtccggtgtaaagaacgtaaatgaacagaacggagaacgatccccgttttggaccggtgtcgcggttccgtctgaacggagacggtaaaattcgccgtcaaacccaatcagctctccgtcaagcttgttaaaggttccgataccgaagtctccatatttcggaatctctgacagttcaaaatctccgtcatatactccgtctaatagagaagtcattgttgatacttgataaatctggctcacaggctggtctttttggccgcggctgagcacttgaatgttgctttctcgtttcatatttcccttcactccttttatttagtgctgttcataaaacagtgtcgtgatgcgcagagtgctagagagctttcgttttcatgagttccccgaattctttcggaagcttgtcacttgctaaattaatgttatcactgtagtcaaccgggacatcgatgatgacaggaccttcagcgttcatgccttgacgcagaacatctgccagttggtctggtgattctacgcgcaagccagttgctccgaagctttccgcatatttcacgatatcgatatttccgaaatcgaccgcagatgtacggttatatttttttaattgctggaatgcaaccatgtcatatgtgctgtcgttccatacaatgtgtacaattggtgcttttagtcgaactgctgtctctaattccattgctgagaataagaaaccgccgtcaccagagacagaaaccactttttctcccggtttcaccaatgaagcgccgattgcccaaggaagcgcaacgccgagtgtttgcataccgttactgatcattaatgttaacggctcgtagctgcggaaataacgtgacatccaaatggcgtgcgaaccgatatcgcaagttactgtaacatgatcatcgactgcattacgcaactctttaacgatttcaagagggtgcgctctgtctgatttccaatctgcaggcacctgctcaccttcatgcatatattgttttaaatcagaaaggattttctgctcacgctctgcaaattctactttcacagcatcgtgttcgatatgattgatcgtggacggaatgtcaccgatcaattcaagatcaggctggtaagcatgatcaatgtcagcgataatctcgtctaaatggataattgtccggtctccattgacattccagaatttcggatcatattcaatcgggtcatagccgatcgtcagaacaacatctgcctgctctagcagtaaatcgccaggctggttgcggaacaaaccgatacggccaaaatactgatcctctaaatctctagaaagggtaccggcagcttgatatgtttcaacaaatggaagctgaacctttttcaaaagcttgcgaaccgctttaattgcttccggtcttccgcctttcatgccgaccaaaacgacaggaagttttgctgtttggatttttgctatggccgcactgattgcatcatctgctgcaggaccgagttttggcgctgcaacagcacgcacgtttttcgtatttgtgacttcattcacaacatcttgcggaaagctcacaaaagcggccccagcctgccctgctgacgctatcctaaatgcatttgtaacagcttccggtatattttttacatcttgaacttctacactgtattttgtaatcggctggaatagcgccgcattatccaaagattgatgtgtccgttttaaacgatctgcacggatcacgtttccagcaagcgcaacgacagggtctccttcagtgttcgctgtcagcaggcctgttgccaagttagaggcacccggtcctgatgtgactaacacgactcccggttttccagttaaacggccgactgcttgggccatgaatgctgcgttttgttcgtgccgagcaacgataatttcaggtcctttatcttgtaaagcgtcaaataccgcatcaatttttgcacctggaatgccaaatacatgtgtgacaccttgctccaccaagcaatcaacaacaagctccgcccctctgtttttcacaagggatttttgttcttttgttgcttttgtcaacaccctcactccttattatgcattttaaacgtaaaattttaaatatcttgtgataagtttcactatacactctttggaaattgacctccaatatcgattcgccttatgattaatatgtaatacgaattattaacctatggaaaggaatgcatattgaatggagcttcgccatcttcaatactttatcgcagtagccgaagagcttcatttcggaaaggctgcccggcggctgaacatgacgcagcctcctctcagccagcagatcaaacagctggaggaagaagtcggagttacgcttctgaaaaggacaaaacgatttgtcgagcttaccgcagcaggagaaatctttttaaatcattgccgcatggccttgatgcaaatcggacaaggaattgaactggcacagcggacggcccgcggcgagcaaggccttctcgtaatcggttttgtcggatcagctacatatgaatttctgccgccgattgtccgggaatatcgtaaaaaattcccatctgtgaaaatagaactgcgtgaaatatcctcgtctaggcagcaagaggagctactaaagggcaacattgatattggtatacttcatcctcccttacagcatacagctttacatatcgaaaccgcccaaagcagcccttgtgttttagctttgcctaagcaacacccattgacttctaaggaatcaattacgattgaggatttaagagatgaaccaattattactgttgctaaagaagcatggcctactctatacatggattttattcagttctgtgaacaagcgggcttcagacccaacattgtccaggaagccacagaatatcaaatggtgattggtttagtcagcgccggaattggtatgacatttgttccttcctcagccaaaaaattatttaatttggatgttacttatcgaaaaatggaccaaatacagcttaatgccgaatgggttatcgcttaccgcaaagacaatcataatccgcttataaagcattttattcatatttcaaattgtcagcagacaagaactaaagagagtgatgcaggtacatgaacgatacttgcaatctcttttttcttttgggattcttatggaaattttattaatttaatataatcgcttagtacaacttcatatcagtatacgtatacatacagtacaaatagttggcaaggacattagtaagcgcaggacattagtttgattttaaaaatgaaagatagagaggtgaagtaaattattgagttcaccggcatattcacattgctcgcttttttcgtaacaatgatttttattttctggagaccaaaaggactaaatgaagctatccccgccacatttggtgctttaatggttttattgtgcggaagtgtgtcattggcagacttaggggaaatcggaacaaaagtcacgggtgcatcggttacaatccttgccactatgattatggccattgcactagaaagctttggtttcttttattgggtggctgcaaaactgctccaacaatccaagggttcaggcatcaagcttttttggctaaccaatttgctctgctttctcatgaccattttcctgaataatgatgggagcattttgatcacaactccaatccttttgcttgtactaaaatatttaggtttaaaaaaacatcaaaaaaccccatatttattaagcggtgttttaatagccacagcctctagcgcaccgattggcgtaagtaatattgttaatttaatttctctcaaaatcattggaatggatctatatcttcacactgccatgatgtttgtccctagtatgatgggactcatttttatgacttgtctactgtttatgttcttttataaacgtcttcccaagaacctgccagatataccgagccattttcagtctctgcggcatagaaggtaccatcctcttcattcgccatcagctcctttaccagaacgaaatcaaacaaaaatcatgttgtttgtgcttgcatttgtttttctcgtcagaatgagtctatttgcagcatcatataccggtatttctgttcctctagtcgctgtcatcggatcttttatcctgttgagctggagatggatttatttcaaaacctccccaagagacttgttatataaatcgccttggcacatttttatattcgcttttactatgtatgtcttaatttatggtctgcataatattggattcactgagttacttgtgaattattttgaacctgtcgtttctggaagcctcgcccacgcaactttcgcatcaggtatctctacttcagttttttctaatctctttaacaaccatccagctttaatgatcagtacttttaccttaactgaaatgaccctgaatccttcaacaacaaaaatcatctacttggcaaatattatcggcagtgatatcggttcattattattacctatgggaaccttagcaacgcttatttggatgcatatattaaaacagcatgatgaaagtatttcatggggcgaatatataaaaacgaccattatcatcattccgctgactgttttttttacgttaacatgtttatatttttggatcagttggttatttctttagtacagtatgaaacgaaaaactgccttctgctattcaagagggcagttttgcatacactagggaagatgcattgtctttagatgatttaacttccaaatgattggctctccatttgcgttaataagctcaatgatattattagagacatcctttaatagaccaactttttctggcacctctcccatatcaaatatgaccaattcaccaatattttttttgatctgctcctcaaaattacgcacaagaggaactttggaaggcacgacaggcaattgtgagttgtcaagagtgtacggtgtttgttcagttgaataaggggtaaaccattttaaatgatgcatagatataaaaagtattttaaatacaggtgagaaaaatacaatataatcgtttaaaacatttgtaacatacccatggatcgatcgacccccagttacataaacttcaataaactggcctttgaccttgtttaatgtatttctatatgaaaaagcttgagtttctgcctctatcattggatcttccggattgatcaaaaatggcttctcagtactggtcattattttcgcctttttcatttgatgaagatgcaacaagggaatataaagataattgcagccatcaaaaataacaaaaatatcctgtccgatatctatgagggtgccgacaaaccttgtatctcctgaaatgacaacctcaacatctgtgttaaggaattgattcaaacctttcacgattctcctcctttaactgaaaaagggcatcacttaatctgatgctcctccattatctattaaaatttacgtttccagtgatagtctatcgttctgacaatcgtttcatagctataatcttccttttgttttcctgaactttttattgaacttgaataacctggtgatcttgatgattgataatctgaagatcttggtgatcgtttagatgattttgatgaactctttgaacctgatgagctgtatgattttgatgattgataatctgatgatcttggcgatcgtttagatgattttgatgaactttttgaacgtgacgaacagccagatttggatgattgataatccgaagattttagtgatcgtttagatgattttgatgaactttttgaacgtgacgaacgaccagatttggatgattgataatctgaagattttagtgatcgtttagatgattttgatgagctatatgattttgatgagctatatgattttgatgaaatgaacgaattgctgtccttatcattattgtcttcctggctttgttcattcttttgatcctcttttttgtacgacccttttgggcctaagctgatgctttttatgtgataagaatagatgcgaagcacctcttgatttttcactatagtataatggccgtcggcattatctacaaggataccctcaatggcttccggacctccacgattaattgaaacccatttatgagtcagactcttaaaaacctcgcttaaatcatcagcttccaagacacctgatggcgtctgtccttctattttcaaatcgggctcatgtttacttatactctttatgtgatggatattaaaatacactaccccatcctcatttgtgtttaacgcagcgtaatcatctcccagccagaccaatcttccttttttagattccggacccccttgattaaattgaactgattggttcatgaattgtccgattaagctatgaaaatcgtcagcgtcgggcatttcctcagtctcaattgctgtggtgctattattggtatcctcagtaatacttttcacatgatccaactgataataaattatttttttttcagcttgtaaagcaatataatctgattttacagcagttaatttcccttttttagattccggacctccacgatatacagtaacaattttatctttcattgaatgcaaaaagttataataagatatttcatcatttgaatgatacttcattctcctcttgctcattcaagttcctcctagtcacttatacatagatgataaacatattgcatatatacgtgtcacgtttatttgttgaactaattcaatagcctaattgtcgctttttcagcagaatacctattttcacacattcataaaatacttaaattatttttgaggtattgtgaacggtttttaatatattcacaaatcacatccggctcgcggtcaaaacgctcaacatcattctttttgtatgggtccatcaagataaaaggcctaatccgctcatacatcgccatgattttcggttccatatattctatcgtaaaaagagattggagcgttttttctaacaggcgcttgtaggacttgcgaaactcggattcatccaatatccgggcggttagtgtattaaatccttgaattcttacataatcggcagccatccgctctccatggatatccctgccccaggtcgcatcataatcccaaggaatcacctcaaataatccggtttccccgcttctgtataatgcgtagttgtggacaaacccgtcatagttcgaggtgaatacaataccggcaagccagcgcaaatacttatcgacatccacgtgttttgtcacttctgacttaaactgagctttagggacagtattaattttaaaaatcatatcctgtaaataaaaatcatcttccacagtccctgtcttcttttcatatccaagctccagcgacgtcttcgtttccttttccaaatcgctcatcagagaaaaattagcatcatcatccaccgcgtaaaaaatcgcgccatcagccagcttccttttcgccaaataatattcatctacggattcaagttcaagataaaccccttcattcttcccgttcacctttacaaacacaaactctgcctttggagacagtgtccctagctccgagaaaaaatccagagacaatttgtttctcatcaaggaagggtctttatactccgcatttaagtgaatctctcgcgcgccgcggaatgttttcggctgataaaaggaaatatggtatgacttctttttgaagtctctgatatgtgatccccgataagcgatatcaatatccagccttttttgatttaccttcatcacagctggcaccggatcatcgtcccatatatccttttttaattcacgcaaatcttttggatgaacaaacagctgataaagcggtaaattggattgattcttcatccataatcctccttacaaatattaggcttttatttttataagatctcagcggaacacttatacactttttaaaaccgcgcgtactatgagggtagtaaggatcttcatccttaacatcatttttaaaaggaggatttcaaattgggccactattcccattctgacatcaaagaagcggtgaaatccgcaaaaaaagaaggtttaaaggattatttataccaagagcctcatggaaaaaaacgcagtcataaaaagtcgcaccgcactcacaaaaaatctcgcagccataaaaaatcatactgctctcacaaaaaatctcgcagtcacaaaaaatcattctgttctcacaaaaaatctcgcagccataaaaaatcatactgctctcacaagaaatcacgcagccacaaaaaatcgtaccgttctcacaaaaaatctcgcagctataaaaaatcttgccgttcttacaaaaaatctcgcagctataaaaaatcttgccgttcttacaaaaaatctcgcagctacaaaaagtcatactgttctcacaagaaaaaatctcgcagctataagaaatcatgccgtacacacaaaaaatcttatcgttcccataagaaatactacaaaaaaccgcaccaccactgcgacgactacaaaagacacgatgattatgacagcaaaaaagaatactggaaagacggcaattgctgggtagtcaaaaagaaatacaaataatctaagttttcattgtttcaataggctgccggcggaggtacggaagcctatttttttatttgccctgtattagatatatgtcatgacataacatatgcaacccgcatcatttggtttcctttaaaccatttcgttataatcaaggtatcctaacgataaaggcggttgttgctatgtacatatttcaagctgatcagcttagtgccaaagacacatacaagctattgtcaggtaccgttattccccgccccattgcatttgtgacaacactttcttcagaaggagcggtcaatgccgcacctttcagtttttataacgtcgtcagctcagatcctccgcttctcagtatttctgttaacaggacggaaggacgccaaaaagatacagcgcgaaacgcagtggagaacggagaatttgtcgttcatgtcagtgatgaagccatcattgaagatatcaatgaaacagctgcaagcttaaggccggatgaaagcgagcttacacgcacctcgcttcatcctgttgaaagcaaagctgtttcagttcccggcattaaggaagcccgcgttcgctttgagtgcaaattagatcggcatattacctttgacaatgatcaaggcatcactacagcagatctgctcatcggaagggttgtctgcttccacctagatgaaaaggtgtatgatgcagaaaagggatatattttaacggatgaattaaaacctgcctcacgattggcgggaaatcactatgccaagctggggaagaattcacactgattcgtcccagctgaagagaaggactatttaaatagaagaaactagtcaaaaagaccttatgattacaaaatatcgcctgtaaataactgaaaaaatatcaaaaaaaagaacacccagagtaagctcggggtgttcttttatgaaacgtttttcctttttcttcgtataaaggtagatgaggaggaattggaatgacaaacttttggattttaatgctgatcgctattaccatcagtctcgcctctcaattttttataaagaaaaaatacggtattgataaatccggctggcgatataagcatgtcagcaatacacacaaatggatcgaaatcactttacttattttgtttgtggtttcactctccttttttccagttgaatatttgcttcttttattttttattgtgattgactcaatacgaatttttatggagtggcattatagacctgaagataaacagtatatgtaccacattgtagaggtctccctcatgtttatgcttttgatttatatttgtaccctatagttatttaaatccccacagccgctccgtctccccgaggatcggctccgccttggagaaagccttcttcatcaactttgattgcagccgcgtgtcccatcagcggatcatagtcaccgacaacctccacgagatgcccgctgtctttcagtttttggattgttttgtctgtgaatctgccctcgactctgagaccttcgtattcctctccccacgttctgccccatacccagcgcggttcgctgattgcctgttgtggatgcattccgtagtccagcattcgggtaatgatggccgtctgggtctgcggctggccttcgccgccttgtgtgccgtacagaatttttggctttccgcctttacagaccatagccggcatcaacgtatggaaggtgcgctttctcggttcaagcgtgttgacatgattttcatccagtgagaaaaatgatccgcggttttgcagtaatatgcctgtatcaccggcagtgactgccgagccaaattcaaagtacaggctttgaatgaatgacactgcgttgccatccacatcgattacggccgcatatgccgtatcacttcccacctgcctgctttctgccggttctgccagatagccgatttctcccgccaatcgtttcgcataatttttatctaaaagcctttcaagcggaatgtcagcaaacgcagggtcagtcaaaaaggcattccgatctacaaaactctttttcaacgcctccacaagcacatgataatactcaaatgaaccgtgctcgatttgggtgaaatcatagttttccaaaatgttcagtgttaataaaccggtaaatccctgagaattcggcggcgcctgatacacactgtatcctcgataatcacttgatacaggcgctgcccactcaccccgatgcgctttaaaatcatcgattgtcatgtaactgccgttattctgtaaatgtgagacaatccgctgagcgagatctccttcataaaatgcgcttcttcctttttcagcaatcaagttcagactgtctgcaagctctttttgcacaaaccgctctcccgggacaggtgctttgccccttctcgtgaagatgtcagccgtgtaaggcgtggaagccagcaattcaatattcttttctgtgtgacgacactgatcagctgatacaggaaacccattttcggcataatcgcgtgcgggctccaatacatctgcaagagacagacgcccgtactccttcaggaccgcatcccagctatcaaccattcccggcacggtaatggcactgtcaatcccccgcagcggaatcgcgctttttcccttatatacatctctcgttacgttttttcctgaacggccgctgccattgtagacttttactgcctttgtttcctggtgtaaggtcagccaaaaggaatccccgccaagtccggtcatatgcgggtacacaaccgcaagacaagcactcaccgcaacagcggcgtcaaacgcgttgcctcccttatccagtatgcggtttccggcttgagaagcgaggtaatgcggactgacgaccatttgctttgtaccgatgacagatttgttcatcacaagtccccctttttaagaaattttcttcagtatagggagcctgatttttcacatctactgatccggcagaaaaactgacgaactttcttcttttcgcaaataataagatattttcgcattcatttcgaaaacaaatgaaaaattattatttcgatacgtaacttttatgataaaatgattgctaaaaggctacgaaagcaggtggagcaattgagtcatgaatatcaaatccccaaccttgtacttgatgagactgataaacaaattctcacgattttgcatgaagaaggcagaatttcttatacggatcttggcaaaagagtcgatttgtcacgggtcgccgtgcaggcccgtatcaaccaattaattgaagccggtgttattgaaaaattcaccgctgtcatcaatcccgctaaaatcggcattcatgtttccgtgtttttcaatgtcgaggtagaaccgcaatttttagaagaggtcgctcttaagcttgaggaagagcctgcggtcaccagcctttatcacatgacaggcccgagcaagctgcatatgcatgggatctttgccaacgatcaagaaatggaagaatttttaacaaaacggctgtatccattgcgaggcgtcgtcagtgttgattgccagatgctgatcaaacgatacaaaagccgtatgggaatgaagctgtaaaggagagaaacgaatgaaaaaccatccttatcgggatatgacggccgcaatggttcgcaccggcatattagggttcggcggcggaccttccgtgattccgctgatccgccatgaagcggtcaataaatataaatggattgacgatgatgaattcggagaaatattagcaatcgctaatgcgcttcccggaccgattgccaccaaaatggctgcttatctgggctttaaactaaaaggcacattaggtgcagttgtggcgaccctcgcccacattctgcctacatgtcttgcgatggtgggcttgtttgcggctgtaaatgtgttaagccattcagcaattgttgcaggtatgatcggtgccgtcacgccggtaattgcggtaatgctcggaatcatggcgtacgagtttggccaaaaagcgcttaaaggtttcggctgggttaccggcatcctgttttttatcatcgcttttatcggcctgcaaactttacagattaatcccggcctggtcattatcattttcttagcgtacggggcgtttcattttaaactgaaagacaaaatcacaaataaacattcaaaagataaaggaatgtcagcctcatgatatcgatctatttatttatggcgttttttatcgcaaacctactgggatatggcggcggaccagcgtctatcccgctaatgtttgaagaagtcgtaaacagatacagctggctctcaaacgatcaattctcaaatatgctcgcacttgcgaacgctttgccgggcccgatcgccacgaaaatcgctgcgtatgtcggctacagcgcaggcgggtggcccggcttcctaattgccctgattgcaaccgtcgtaccgtccgcgctcgcattgatcatcctgctgcgcatcatccagcgcttccgccaatcacctgtcatcaaaggcatgacgctgtccgtccagcctgtcatcgcggtcatgatgctcattcttacctggcaaatcggcgcagacggcatcaaagcgatcggctggatccaatctattgtgattgcggggatctccctccttgccatgacaaaattcaagatgcatccggcgttcctgattattgcggcgtttttgtatggcggccttgtgattcctcatttatagaaaaaagcacctggacaggtgcttttttattttggcccagaaatgccgtttgatatgacagctgtttcttctcctgcgtcactcttgatgatgtgcttgacttgcagcgtggttcctgccattctcacagattgctacaactcggacgaattggtttcaacttgtatccaaacaggaggctggaccttccaaaataaatagagtgcaagaatcatcaagccagcaatgaccgacagcaaaaacttcatatcgcatcgcttcttttcagtaagcggctcgcagcggacagcgcctgatgatcacgaagaatatcgcctggacgattgccttctcccagcacatagcctttaaaggacattcccataaaatgaaaaatatgttcgaattgctgaatcagcggcagcccttttatttttggattgtctccgcccactgctattacatatgcctgtttcactgacatttgctgtttaaaatcaggaaatctcggatctctcaacgtctgtgaccagcgatcaataaacagctttaatgtccctgacataccaaaccaataaattggggtggcgaatacaagaatatggcactgcaatatccgttcaatgatagaatcgtagtcatcttgaacaggacgaaagccgccttgggcgtgacgcagatcttcaattggctgaattcgatatttctgcaaataaatgtgctccgcatcgaatccttgaacagccttctccgcaagaacatccgtatttccgccagaccgagttccgccgttaataaccgcaattttcatgatgcatctgctcctttgtttacgaatgattttcttcatcttataatggattcatcaatcaatacagatgattatttcgattaatccaatcgctaaaaccgatttagaaaggaagagaacaagtggaattgaagcagctgatcacctttattacggcggcagaacatgtaaacttcaccctaaccgccaaaatgcttaattatgcacaatcaagcgttacctctcagatcaaatcacttgaagaagaaattgggacgcctttatttgaacggctcggcaagcggcttatcttgacagaagcaggaaaaacgttcaaatcttatgcacagaagatcattgcgttaacagaagaagcgaaaatggccacaaatcaagtaagagaaacaaccggaaccttaaaaattggggcgacggaaagccagtgcacataccgcctgccgcctatcataaaagaatttaaacaggcttttccccaagtaaagctcatattcaaaccatatatctccaatgaacaagcgaaagaacagctcttacagggccagcttgatatcaccttcatcttggatgtaaaccggatggaagacgcactgcacgttgaatctttgattcaggatgagatcaaaatggtggctgctaatgaccatccttttcctgcggatttaccagtaacattgaaggatcttcaaaacgaaactcttctgctgacagaggacggctgctcgtaccgcacgctctttgagaacaatttgcatgactccggtgtctatcctaacaaattggaattcgtcagcatagaagccatcaaacaatgcgtaatggccggacttgggattggaatcttgcctgaaatgacaataaaagatgatattgcagcaggccagatgaaagaactcaattggcagagcgattgccccgttttcactcaattagcatggcataaggacaagtggatgtctgcgccattaaaggcttttatcgatttgacacggaaaacattcaaataaaacctctccacaaggacgacaaggtttttgagaccagggcacacacatacaaaaaaacacttgatgacttagagccccaagtgttacacgtgatttttctgataaaacgttcgcaaaacatgcgtctcaaggtcagccaggcggacagggataggcagcctgctttcttgattgatcaagctcatcgtgatctgatagctgctgtctaaatcaatataattaccgcaagacaagaaaataggcttcacgtccccccgcgttcgcagcgcccggccatatacctcgccgtcaatgagaatatcggtgtatgcaccgacttcattttcaggcatcacgaaatcatagcctttgattttgagataggttttcgcaatcccaatcgtcggcttgcccagaaaaaaagccgcatgggtggcaacgcccatatgattgtaatgcagatatccgttgccatcaaacaagaagacatccggctccgtctccagctttttcgccgcctcgataatcaaaggcagctcgcgaaacgcaagaaaaccggaaacatacggtacgctgattttccccatactatgcactttttcaatgacttcttttgtatcagcgtcaatcacgataatactgcacactccgtatggttctccgttctgctcccaataggcgagatcgacgcctgcgcaggtgttgatggagttgggatggatcgtgtgggataggttgatacgatttctaagggattgttgtgtttgaacaaaatccgattcatcttttagatgaaaatcgtgtatttgatgtatttccattttacttgtttccctctcttcgcgctcaattgtcctgcatgtcgattctagcaatgacaccaaattatatcattgaaaaaagcagatagtataatctgcttttttattactattcatttttcatttctttcataaaaatataatccaattgttaattaattctttaagttcagtacacataatatcctctaaaggattttcccaatcttcgttttttatcagttcaatcccatagcttccggctggatcaccttctgggtaccaccctacgtcaagcagcaaattttttgtcttatgagaaatctgcaggagatcttgattaaagtcaaataaccaagcatcgtcatttgcctctagcgtcttaggatcagtatcctttaatgtaatataatcaacagtccaaccagccggtatctttagccttaaataattgggaatctgttggcttagtggctgcaaaccctctaaaaccccgcttcccacactccagatttgatattctaactcttctaataattgttctatctcattaaaagactcatcttcataaatcttatctgtttttaagccagctactttgatatggtattgattattttcataacttaccttaataaaggccttacgtttttcattttatagtattagtaattcacatttttcttgcattcttttttctgaacataaattgttcagtactacagaccagccattacagatttttaatggctgcagttgagaaatatggtctctttccatcccgcttctccttgtccttcattggcctatctctaaaaagcctcattactgtaaaaaaacttgccgatgacagcacggcaagtttaaactacagcaattctaatacatcagtaaacaaggcatctcctaatgttaatctcctgttgaaaggctgtatatgcggcaattcactccactcatacacagtatcgtagtaatcatataaataactgagttcaataaaccctttctcttgcattattttattaatatagttcgttccctgaatgaattctaaagattcagcggtacctacaatgtcataagcgccatcgattaaatcgtgtcttagggaataactataatctaatacataaacaggaaccaatttagatactttcatattgatttgctgttctaaatgaaaaccattttccccagaaagatcttgcaaatggatatcaatttctcctgaaggattgtttaaatctctaacttcaatttttttcaaaccttttatttgattaaattcatcaggtacttttattttctctgcgcatttgttcttgtaccattcgtctaattccctattcacaaatagacgatgaagcaactcaccaatttcaggatattcattaataaacctgattccatgttccataaatagtaaccattccatccataattaagaatcattaaacttaattccaccaagtagttgttacttgttttaaatgatattcaatatataaaatcacttttttatagtcatctgatgaaaattctttaataggatcttcccaatcattatctttgactagtaaaaccagataattaccttcaggagaaatgtcaggaacccagcctaaatcaagcgttattgaggattgttcatgataaagctgcaacaaactgtctgtgaacaaaaaccaggaatcatcattcggttctaatgttcttggatctatttcaacaaaatgattataatttactttccaaccttgtgttattcttaagggatgtatattagcttttggaacatctaatttaatatgttttcttaccatgagaacctctgtcagtaactattaatttcctaaactttattttttataaggttcaatgctataaattccggttcaatctcctgggtgcaccccaattaaatacactaattattcatctttagggggtataaaagcgactaattgaccttcaggatatatacctttccatccacaaggccatccgcctgatttatacacttgaaacattttctcaaaaagattgtctttattaccgtttactagacgatttattgcacatttatacagatctgactctacttcttcagcaatatcccaaaaatccataggaatgaaatcttcagaatagttatcatcagaattgaaaatattcgacaattcttcatctaatgtttttaagtgctcatcatttaaaattatacccaacaactgtccgctttcatttgattttacatcttgccaaactacttcaacttcatcagtatcttgagaccatgctaattgttgcgctatctcaaaatcttctataagtgtaatatcagacaaattccgattattattcttaaataattctccgtgtttaataaagtcaattacctctttcactaaatcactatatttaccgtaactactcatttatttaaccacctttcccataattcctctgtagccccccacctctttgccaaatagggagctttttgttttgaccccttttataaaatttttctacatttttgattttcgatttataaagaggtattcctttttctacccctaattttagtttttgctgtaattcatagacttgttgttctaaaatttcaacactttcattaatgtccattttatttaactgtttttttacaacattattataaacactatgataacctctatgtctagacaaagtacttattgcctctgcagggattggtaagaaaataccgttcgatgcatgatttgtttccattccaatttttttaattataggatggttatatagttctccaggaataatatgttgggcttggtatccagtccattttgatgaccgcggtaatcccatagattctaacaagtttttcccaagttcagttgaatcactttttgttgtatgacccggtcgtcccggtattttcctcttctgctctatcatcggacccttagtgcctttaccactactcaccatcttcacaaccccaagatctttcacagctttcgttttcacatcagcgtgaacaattgggaaagttgtcccatccggtgtgacagtcttgtggacacgaatttttacattcgtcggcactttgaattcttttacttgatctagaatctttctccctttttcaacttttgctacttgtggcgatttagcaagcgggatgcctttatcaatatgtttcgccaatgcaccggctccaaccaagctcaatgccgcttcgagcgccccttgcttccgcttctcctcagacactttgtttccgaacatatcccggcctgtgacggcttctgagaatccgtttgacgctacaaggccgtatgcacccatttctgtcattttgagaatgtctaaggatttgcctgttttgtaggcatctaaagcgtgttcagctgcgatagcagcttttccggttttgtagatggcttttccgcctttgaaggcccggcctgcccagccgacgactggtatgaatccggcagcagccatagctcctgctgtcacacgctctgcggtggagagtttttctccggtaaccggatcaacgccttcggttgctcttttataatcataatagccagtgacttctccagtaaagttgcaaactccatcccatgttttttcgtaccacggtttgtttgcttcttcctcggctttttcctggagccgtcttgcttctgcttgctgggtttttgcatcgatataggttgttccttgattttctacttcaatgacgcttttgtagacttcattgctgtggaaggcttttttgtcatagtacataggagaagcgctcttcccattgctggtggcctgcatgagaacggaatatttggtgagcactgcgttgtccagagattctaaattttgatattcagttgtcagggattcatcaagcttatcgacagctgtgatcgtgtcacgtctgattttttgggcatcgcccatcttatctgcatagtcgtcaagtgtatacatgtcgaggtcaataatatcgctgatgcctgacaaaatagaatcgatttcttctttatgagcggagactatctctgaggctttcaggtctccattgggcagctcatgatctaaaaaagaagtttccacatatgaatcattcagttcttgatctttaatatctcctgaaatgccatttaaaaacgcaatttgagcagagacaagcgtcagccagctgtctacgatttccgcctgtccctgaaaaaaatctttaatattgtccgcgccttttcctttaaaattatcgcctaaatctgcaactccctgaaacgcttttttcagcgtattcagctgctcctcaagcgtctcatattgcttttttctgctcttcgcttcttcgattaaagatttagattcaaatactttgctcatcgcactgccctttctgttctattttaccgctatcgcctcgtcctgctctttgagtgaatctacattatcctttgtatcctcgatatttttctgtaccgcttttttatagtctccgagcatggttttgatgttctcctcacgctcatggtattttttcgtataatcgaggctgttttttccgttggatcctgcggcgccgattgatacgtcagcaagcgcatctttgacagaatctaatgttttgatgactgtgtcgtacttcagcttaatttctgacataaaaaagatcaccaccattttagtttactaatttgtcttcctgcttcttctacgaaatcttctcctttagcaagaaggtcgcctgcggcattcgctgcactttttgtcaaattcagctcaaatttctctgtctcaagccagaatattttgctttgaatcgaagccatatactcgttatatttatcattcacaatcttagatgcttccgatttcgcctcttctcttcccttgtcgaaatcatcggcttttgttcccgtccaatgcttgcccaattctggtttcacaatttctttgatttcagtgattgcctcttcttgcagtgtgtctatgtccttttttgcttttttcagtttttcgatcttgtcttccacgtcggaaatttttccgttgagcgaacttttgatatccgccagcatactttcataacccatctgaatcacctcttaatactcaaaaagtcgtatggaggggctgatgaagatagacttttccatactttatttccatatattatattttaaaatagccagaaggcggcttaaatagggtaaatggcttaatttaggcatataacgctcttgaaatgtaggtatttgatcttgtttttgttcgttatacagctaataaaagcgttttataaaatgaaatcacctaatgtcatagttataaaggcacttgaaagaggcagatgttgttgatctgcctctgttcatgtttatgttcttcatctggtcggccacgtctgattttgtcatttggcttatattatttccgcttctgaccctttggatcaaaagcttgtattagctgcagtcccagttgtacagaacgtttgaaaagtcttttttctttaaatcttcaggtgtgatgaaaaaattggcgatgccgacgtctccccacattgaatcgacatcatcgtctgaatcaatttgtaaaagcatgatggtgtgttctttatatgcgtattcccggggatcatgctgggtaaaagaagcgtatccgccaattttatggccaaatccgttttcagccagttcattataaatgtcttcttcatcctcgccgaactgaccaaagaactccattgtttccatgcccgtatactgctcaaattgaaaatctgtaggcagcacccattccgaagatttcacaggctcgactgccgcttctgataaaatcggaaaatcacattcgcctgtgccaataaatgaaaaatcagaaacaagctcgtcatcgttttctacgatattttcaaaatagatcactctgaaattcttttgttcacatcgatcgtcaaaattcaatccatagacgtcatcatgaacagaaatgtagaactgcaggatacctgaagaagggtagccgtcaagctggggaatgtgcgagaaattaatctgcgccagaagcttcatcggctgtccattttcgtcagtcggatatgtttcatgcttggggaaatagggatcaccggcaattttgctgtcatatcgtcctgttttcccctttctcacattcagtttcacgtattctttcgctgatttctccagcaagtcgcggtacggtctcattttttcgggcagatgattcatcagattctctccttttccggcatctccaaggttttattttctggttttcttctaatgtttttcaaacgaatgtttaaagaagccctacttctgcataattttccaaacaatagttaaatagtagcaaatgtattcagcaccccgcaatagatgaaaaaaagactggtgcgcaaccagcctttctttttcatctattgaattgcacctgacggaacaaccgccttccgtccgacagaataatactccactcctgcagccaaagcctcatccaatgtgtagcagtttctgccgtcaaatatgagcggcgtttccatcaaatcctgataagccgctaacgggaattgtttaatgtcagcccagtcggttaaaatcatgacggcgtcagaccctttgacagcttcctcgatcgtctctttatattcaacagcttgcgggagaacatgctttgcatggctaactgcaatgggatcgtaggctctgatacgggcgtcgagcgcagcgagacggtctgcaataacaattgacggcgcttctctcatatcgtcggtattcggtttaaatgacaggcctaaaagggcaatcgtttttcccgtcaccccgccgagcctgttcagcgctttatcaaccagcatcgcctgctgattgttgttgactttgataaccgatttcagcagttcaaaatcatgctcgacattgccggcaatttgcacgagggcgtttgtgtcctttggaaaacaagagccgccgtagcctatgcccgctttcaaaaactggctcccgatccgcttatcctgtcccatcccgtatgcgactgcttcaatatcggcaccgaccttttcacatatattcgaaatttcgtttataaaactgatcttagtggccagaaaagcatttgaggcatatttgatcatctcggcgcttctgatatccgtttggtaaatcgggatttgaaacggacggaagagctcctccagcgtatttgctgttttctcatcggccgtcccgatcacgatcctgtcaccatgaaaggtgtcatagatcgccgacccctcacgcaaaaattccggattggatgcgaccgaaatactgacaggctccgctagatgttcagtgatcagtccattaatcaaatcgtttgtcccaacgggcactgtgcttttcgttaccacgactgtatctcgtttgacatgctttgcgatgcgtttggccgcatctgtaatttgctccagattggcgtgcccgtcgcttttctgcggtgtgccgaccgctataaaaatgatgtctgcctgggccaagcctttctcatagctcgtttcaaagttcagccgtccatcagctgtattttttctcatcagctcttcaagacctggttcaaatatgggggaaatgccctttctcatttcatcaatcttgtgagcgtcaatatcaatgcaggttacatgatgtccaatctcagaaagagaaacacctgtcacaagaccgacatagcctgttccgatgactgttatattcattgtttccctccaacagttaaattgctgctttgcagcttccgtaatatcgtatgagaacatcctatcatgaatgcgaatgatctcccgcatagcctgtcgggtacagcctgtacagatttctgaaatgtgattcaaccatacaatacactattatatcgctctcaaaaagaaagtggtgaaatgagaatcggctgttaaaaaagaccaaacaattttcttcttttgaccggttgcggaggctgtctgaagatggtctgattccgcagaagaagctctgcattttccgtcagcatataaggaagttccgagccgaattctttctctagaacataaagagcctcttgagtgtgaaaatttctcgttttcacattatgggcatctgaggctacgaaatggatcaaattggcttcaaccagccggagagaaaatgctttcagctgcttgccgaaggtccccgcaagacttcctgaagtaatctgagatgctgctcctttttccacaagatgatacagcaaagacgggttttcgcgaatttccctgttgcgttcaggatgggcgataaccggaatatatcctttcagctgcaaatcataaaaaagctgctccgcatatcggggaacgtgatcaaacggaaactcaatcaagatgtattttgtatcattcagcgaaagcagctgctgtttggcaaggtcttgttccacctcgccgcagattctgatttcctgtcccggaagcacatgtaaaggaatgtcttctttgattaaacgtttgtttaactgatttgctgcttctctgactgcggctggctcgtttttatacacaccgttgttatgatgaggtgtcgcaatgatcgtccggattccctgacgaacagcggctcttgccatttctatgctgtcggccgaatcacctgccccgtcatccaatgcgggaagaatgtgacagtgaatatcgatcatgtcctagcccccttttttcgcaaaaataaataacgggcacgatgcacgttatttattttgcatgaaattgtccttgtttccgtaatatccgtattcagagtgcttcgaaagctttttgccgtttataatcgccccaaggagcttgcttttgcacgtttcaagcgcctctttcgcttttgcggcttgttctttttctgttttcccacttgaaataaccagaacagaaccgtctgccacgttgcctaaaatctgtgcatctgctacggcaagaataggcggcgtatcaaaaatgaccatatcatatgccgcacacgcttcgtatgcaagctccttcatccacttcgaggagagaagctcggccgggtttggcgggatcgggccgctcgtcagcacgtcaagatgtttttcattcgatgcttgtacagcctgctccatagagcttttctttaataaaacagatgttaagccaaccgtattttcaagaaaaaaggccgtatgtactgttggttttcgcaaatcagcatcaatcaggagcactttttttccctgctgggcgaatacgacagccagattggcggccgttgttgattttccttccccggacaagccgatgtaatcatgactgatttcatttgccggtccactgaagcaaattctatattcgtgcgaatcgtccgatattgttcagagttcaaggatttcggctctgtcattgcaatgacatttctccgcatccgcgagtctctgctttttttaagtgccaaaatgtccactccccgttttttcagattggaaaccctgtaaggtctttgctgttttctgctcattcgcaatggtggaaactgtccctaaaacaggtatgtccagcaaggattcgagctgctcttccgatttgatcgtattatccaaatgctcaagcaggaaggccagtccgatgcttcccgccaatccggccgcaaacgcgatggcaatgtttagaagcggctttggcgatacaggggacggatgttctgaaacctcggcttttgacagaatgctgacattgtcaacattcataatagatgtgattttgtcttgaaaaacagatgctatagtattggcaatatgagccgctgtttccgcgttttcatccctgactgatatgttgaccacttgggagtcctgttcgctggatacggtaattttgtcattcagttcttgggatgtcatcgacaggcccatttctttaatgacttcatctaaaatggcagggctcttaatgatgacattgtacgtattgattaactgaagattggtttggacatcgttaaattggacttcttttcgttcatttttcgattggttgaccagaatctgagttgaattttcatagatgggtgtaagtgcgaagaaactaatgagtccgccggcagcagtggcagccgcggttacaatcataatcaaaagtatgcgttttgttaacgttgataatatctcttttaagcttgtagattctcccatgatacctccaaatctcttataacatccttttccatctacgattatacaacgttgaaaccgcatttctccagcttttcacgtgacataattcgacatttttttacaatgcgttatgttagtactttttatgtaagcgctgtatttactgtgttgacagtgctgtctcattttctcttattcgtgcagtcacatcatctcgcataaaaaaatcccgctaaaggcgtgcgggatttttatgttgcatatccatttttaatatgagaaatcaaattttcaagcatttccttcgtcgtcatctcagatgactgctcaccaatttcatgtgcatgcatcaaaattttcagaaattcttcttgattcaatttcttttcactcatctttttattcctttcagcttccattaagttgaaaacacgattattatatgatgctggttatcaatttgcaatctctaatacatcattcgacacatcccattttttatgtccttttttaggaaaaactttttaaggccgatgtgttgcgatataatagagaaattggatctttttattacgtgactcggttaggagcgataatcatgcttcagaatatgatttccaaagacgatgtgctggcatctgctgaacagttaaaagaacttcttccttacaatgaggaaaatgttcagctgatcaaaaaagcccttattttatatcggcaggattcagtctatcgtttacaagcagtgagtccgacggaagttacggcttacgtgcaggatgttgtgcctgtgcgggtcacattgaacttgtttgtcatagtcaaaagcggctgttcatgtccgtccggaagaatctgccgccatatgctggctgtgtttttatatgtatatgcaatgttcgagcgagtgggtacttttacagagtattggctcgagagggaaaagcttgaggaaagcaaagagctcgtccgccgccagtttcaggaaaaggtgctgcctaatgaagaatcgctttcaagctggcttgctttttttgattcagagttttctctctggcaggcacgtacgccagaaggcagccaaaacatgcagggcctctattacggctacctgtccgcattaaaaaaacatgcgccgaacaagccggagctgaaaagcctgtaccagattcattccgcgattgcggtttggcttcgcatgttcacattgattgaagcgggcaagctgaaccccgaacaagatttttattccctcaatccgtacgttgaacagctgatggatacaatctacagctctattgataaattaaaaacgtacgcgctgtcttttgcgcttgatccgtttttggataaaacaccggatgttatccggcatttgctgttgaaagaagaaattttccaatatgaacgcatccgcgtcttcggtgaaatttggagtgcgctgctgtcgcggccaaaatgggtggcacgcgaacaggagatattgaaaaaagaagcaggacggcgtttttctcccgaattgcaattcgggcgcctgcatttagaattcctgcaaaagaatgatgacgttatttttgcggaagcggatcaattcccgccagaagcgctcccttatacattccaatggctgagtgaaatgactgccaagaaggactggaaacggcttaaaatatggtaccagcaaattgaaccaattgcgatgggttatacgaagctggataagccgtttaaagagattcgcgatgtgatcggcgagctgttccttctgttgaatgcctatgtgaagcaaaccaatgatcaagcgctgtttgaacgctttgccgcgggctgtctgccgtatacgttcacagaatacagccatcatttatatgaaaaaaaacgctatgccgagtggattgaaattcatagccttgtcggcttttccatcaatgaaatggataaaatgatgctcaaggaaattgcagcgagcgaccctgaggcgcttataccggcttaccatagagaagtggcttttttcattgatcagaagaaccgcagctcgtacaaggaagccgcccggtatttgaaaaaattgcgcaccctgtacaaaaaagcgaaaaagcagaaggtgtgggagcggtatattcagctgctgagctcgcattacaagcgcctgcgtgcgcttcaagaagaactgcagaaaggaaagttgattgatggcgagtcttaaagaaattctcatccacgtcgaacaaatggaagatgggtcatttacgctctcagcctttgatgagaatgagcagcctcttccctacaaccatatgaaaaagcatttgttccaatggcatgaatcctcattttacggaacctttctagaggatgtcagcttcatcgggacgactgctgtcctgctatctccatggatgactgtagagcttctcggcaaaaactcgttcaactcattcagctccgtgcagcttacagaagaaacggagccgctgatcgaggcggcatcgaccatctatgaatttatcgcggacggcgattttatgcctgactatgacgcatggacaaacggtgtttttcgctggaaggaccgcgataatatactggagggctttactgcggaatggttttccgctgccgtacaggattacatccagtacgacgatgacctgcgggagaaatgggaacatatcaaggagaaatcgcctgcggttacgacattccgcggccattttcttgatgaagaggattttctggaaggcattggctggattgacgaccaatctccatttactgtcggcttgcgcttaaatgaaccggactttgacggagacgaatggaagatcgagatgtttttacgcgataaaaagagcggtgctgtagaattctttgacggactgaagagcctcaaaaaatcgtggcaggcgtacagcgataaaatcgcgcgtgagcaggaccgctttcacagaacggttccgtggctgtcgtttgattccgggacaacgctgatctcggaggaagaagcctggatcttcctgtcagaagcaagtgaggcgcttgtcgatatggggtagaaatcctcctgccgtcctggtggcagattgtcagagacagcaacatgatgctgaaagcaaaggtgtcgtcctccccgcgcggcgagtcatttgtcggcatgaatgcactgcttgattttaactggcggtttgcgacaaatggaattgaactgactgaggctgaatttaatgagcttgtcgccagcaacaggcgccttgttaatatccgcgggcaatgggttaaaatcgatccgcagtttatcaaacagatgaaacgcctgatggaaaaagcagaatcagagggactccacatgtctgatattctggcgcgtgagctaatggatcagcaggatggcggacttgaggattcggatctgattgatacatccgctttcgccggcattcagtttgatctgtctaaacagctcaggtcactgattcgaaagctcactgccgcggaaaacctgccggagcacgaagtcagtccttctttcaaaggaacgctccgcccttatcagaaatacggcatgaactggctgctgtttctgcgggaaagcggttttggcgcctgtctggctgacgatatggggcttgggaaaacgattcaaatgatcgcctatttccttcacgtgaaggaaataggccggcaaaaaacgcctcatttgattattgcgccgacatccgtacttggcaactggcagcgggagcttcaaacctttgcccctgatctgtctgtcgcgctccattatgggccgcgccggccaaagggtgatgatttcgcagcgcattatgaaaacgcagacgtggtgctcacttcatatggactgtcacatgccgatactgaagagctttcttctgtgacatggaacacgatctgccttgatgaagcgcaaaatattaaaaacgcgcatacgaagcagtcacgcgcaatcaggaagctgaagggtcttcaccatatcgcgctgagcggcacgccgatggaaaaccgactgactgagctgtggtctatttttgacttcatgaataaaggctacctcggcagtttgaccggcttccataaacgctatgtgctgccgatcgaaaaagaccgggacgaaaagagaatcggacagcttcagcaattaatccggccattccttctccgccggacgaaacgggatgaagaggtcgcgcttaatcttcctgagaagctggaagaaaaagaatttatcccgctgtcagccgagcaggcatccctttatgagcagctcgtcaaagacacttttgaccatatgacatccctgaccggcatgcagcgaaaagcactgatcctcagcatgcttggacggcttaagcaaatatgcgatcatcccgcgctttatttaaaggaagagcaaaccgagctgctggccggcagatcagtcaagctcgaaaaattgctggaactgatgacagcgatccgcgcccaaaacgaaagctgcctgattttcacgcaatacattcagatggggaacatgatgaagcggctgcttgaaaaaacgttcggggaacctgtgcaatttttaaatgggagtctctccaagcaagagcgggatacactcgttgagaaatttcaaaggaaagaatatccgacactgattctttcactcaaagctggaggcaccggacttaatttgaccgccgccaatcacgtcatccattatgacagatggtggaacccggcggttgaaaatcaagcgactgaccgtgcataccgcataggccaggagcgctttgtccacgttcataaaatgattacgacaggaacaatcgaagaaaaaattgatgtcatgcttgaatccaagcaaaccctgaacgatcaaattatccaaagtgaaaactggattaccgagctttccacacaggagctcgaagaactgtttacattaagcgcaacagcgcaataatcatgactaaaaaagctggctctgaaagagccagcttttttccgttcatagccgtcacgccgaatttccaaaaaatccgttacgccggttatatcaacaggatgcgcttttggagcagcacatatacctacagcaaatgtttcatcatatgtgcgacaccgtgttcgtcattggttaaggtgacagcatcggctatcgatttgatgtcttcccgggcattgcccatcgctacaccttttcccgcagcctccagcatcgatttgtcatttaaactgtcacctacagccgcggtttcctcgagcggaatatttagctgttccgcaagcctcttcagcgcctgccccttggaagcttttcgggaagaaagctcaaagttgtgctcagccgaactgacaagcgtcaaatcttcggcatgctcatatcttttccagcctgcctcaagcttttctttgaagaaagaaaagccgagaatattataaaaatcgattggctcatcggcttcaaacagctcttgaaaggagttaatgtaagcaaagcccgattggctgtattgcacctcggccgcctgcttaaggacagaaagatccgcttccggatttgcgcttctgaatctgtcgagctcaacatcaagaagttctctgccgttttgcggtgtataaatcgctgaacctgtgaatacctcataataatagttttccgactcaagccatgagagaatgtcatacgcccgtttcttatcaatcgtttcgtgatgataaagcctgccgtcgggatcgtgaatgacggcgccgtttgcactgatgacccatgttttgatccccagcggttcaaagattgacatgacgtcaaaatgagcgcgcccagttgacaccaccacttcaatgccgtccagctgcgcctgccgcagtgcgttttcattttccaagcttacctgatgcttgctgttgagtaaggttccatctaaatcaatcgcaattaatttcacgtttgtcagtcctttccttcatcctgctctgtcacgagaagctcaacgccgtttcggtcaagcaagtcacaaaatgcctgattcggcagcctgtctgtaatcaaaaggtcgatttcattcagctccgcatactgataaaaactggtgctgcccagcttcgaatgatctgcaagcgcgatgacctgctttgcctgctgtatcattttccgcttcaccatgccatcctcttcatgcgcaattgtaatgccatgttcggaaataccgaccacaccaatcagcgctttatcaacatggtagcttgagagcttttcaatcacagaggacccgtacagaaagcggtgctccttttccagcttgcctcccagcagataaatttcaattccctctttatcggacagcacatccgcaagattaatcgaattggtgattaccgtacaatcaaccgcattcaaatgctttgcacatgcctgaacagttgtagaggcgtctaaaatcacccggtcaccatcatgaataagcgatgctgcaagcctgccgatcttatttttttccttagacactgttttcaggcggccggaatagctttgaattttctgatgcacagtcggcaaaatggcgccgcctcttgtgcggatgatggcattctgttcctcaagtttcacaagatctcgtcgcgctgtatcccttgacacttgcaggagcgtacagatctgctccgttgtaattcggttatgctgttttaaaaaatccaaaatcgctactaatctttcttcttggtacacgccctcattccttttctcagcaatcatttataagcaattataagtttttatttaatcttattcaatattaataagtgattttaagtaaaaatgcgtcgagagaaccaatttttcctaagtggacaaaaagaaagaaccagtctggtcgactggtcaattttgaggggatgatgcgaagatccggataatagtgaatggatagataacgggaggagcagggggtgtcaatcagcagctttttcccggggtttagggtccataaaacgaacagtgtcagccaacacttctgttacatacacgttaacgccttccgcgttttcatagcttcttgtctgaatccgtccgcttacgccgacgagagaacctttttggcaatacaacgccgtgttttcagctgtttttctccaaagtgtgcaattgacgtaatcagcttcgatttcacctgaagcattcttgaagctgcggttcaccgcgagcgtaacatgtgcaactgccgcaccggtggaaatgtagcgaagatcaggatcttttgtaagacgtccgacaagcatgacctgattgaacatgcgattcctcctctccttgcggttgtatgtattgtaaatgatgcaacaagaaaagaaaaacgcttaaaaatggctttcagcctctgtttttatctttcgttttcatttttccttcagctaaaaacatcttttgcttttttcctttgaagaaatatgtactttttaaaaaacggaaaaagatttgctttgtcagccagttttgcgtattcatgcgcacataggaagagccatcccacgcaaaccactgaaagctcaattttttttccggcattgacagcttgattttatactgctccatgccatcttgtgtttcgtataaaaaacttattcttccttttttgttcagatgaacctcaaacacttctttacggcttaacatatatgttacttccttttgaatcaaatgactttcagaaggaacgccgtcaatataaatttcttttaaacgaaattgattcataccacatctctccgtaatccatagtcagttacagtataatgaaaaaatagaaattattaaatgtttcactcatacaaaattctttagccccaacattgcaggattttttcctcgaaaacgtttatgttataatggaaggcaagaaaactttggaagtaatcggggtgagaagaaatgaaaacctttaaactggttgacctgaatgtggaacgagtggacaaggaagaacaatcaattgaacagtttccccttattgacggactgattataaataaagaagacggtgaaaatcactggctgattgaggcgcttgtacagaaagaacatctgtctttttttgaacagcttcaaaacagccaatctgaagccaaagtatttgtaacgatcacgaaaaaaagcaatcgccccgcccagctgacagcagcagtgaaaaatatcgtcaagctggaagaaagcattcaggttttactctacggacaaatggtcacaagaaaacagcagggcactgaaaccattctcgagtcccttgtaaaagagggctatacaggaacaaaactcattgaggcatttaaacaaaagttataaatatgagggggcatggttccccaaaacagacacagaaccgaagagcatcacaatagacatttagaatagatatgttctgcatgaaaaaaagctgccgttttgaacggcagcttttcttttccatatttaatttgtatggccaaaagaatcaaccaattcccctttcacaacaaggcgcccttcagttttgacagccttgtcacatgtgattaacgtaatctcttttttgtttgtctcctcaattacatctgcttccatttccgatatgatatctttagatgttacagaatagatataatcctttttaaaatccgtgatgacaatttgggcacctgtttttatgttttccagaggtccgaacagaagattcttttgcttcaaatgatggcccgccaacggataatttccctcacccattttttgatccgggcgcattgttgccgcccctatcaaaagattttcattggttgtgccttttacgatcggaagctccagatcgacacttttaattgttatccgcccgataaccgctttttgatcgtgatcaaagccggcctttacagcatccatcaactcaggcggctcgattgaatcaaattcatattccgcttctctctcattattttttttcagctgctccacagttaaggccgattcactctggcttttgctaagataagctataattccacctttgatataaggagaagagatcagcagcagtccgaaaaggatgaacaccgtaatgatcattttcttgtacatgcaaaaaaccctttcttatgcatccttctaaaaacgctccgtgtcactttcacttttcaaaaaagcacctgatcgattcttcgatgatcaggtgccttcaactttatccttttctttgtttctttcttgaggcaacagctaagcctccgcctgccataagcagcaggataccgatcattgctgtcagcatgctgtctgtatctccggtttttggaagggttttgtctgtgttcgactgaccatccgagctgccatctgtaccattggtattcggatgatctccatcatcttttccatttccacccggtgctggtttatcaggatgatcatgtttatcaggcgctggtgttttcactttttgattagaaactacgatctcaacagcttttgactgtcctttttcaattgtgaattcaatcggtgtttcgtcaagtttataaccttcgggagccttcgtttcaatcaattggtagcttcccggcgcaaggccttttacagtgaactgcccattttgatctgttttccagagttcagaaagctcttttccatacccgtcagtttttacaggcttgccgctttcgtccaataacttgaattcagcgccctccaaaacggtatttttatcgtcttgatccacttttttcacatttacgtcacctggtgccaatatgttttccgcggtgatttcgactgttttcgtgtctgtgtttgtgatcttgaacgatataggcgtttggtccaactcataatctttaggcgcttttgtttcaacaaactgatattcgccagctttaaggccgtgcaccgtgatttgtcctttgtcatcggtaaccaaaccggacttcagcactttgccgttggcatctgtcaaattgaactccgcaccttgcagaactttatgctgatcatgctgatccactttggtgaggacaacaaggttcttcgtattaaccgctgttgctttcacttgctcaggtttgccgccatattctgctttaatggtgaatgacactggcttttcggataaaagatatccatctggcgcctgtttttcgataaattgatagcttcccggcgctaacccgtcaacttcaattttgccgccttcttttgagactagatcgtctctcactgttttcccattgctgtccgtgattttgaataccgcgcctgccaagccatttccatcttgatcttccttcatcagctgaaccgatccttgatagttcacggcgatcccggcatctgcggcttcaggctttcctgctgcagattctgagatggtaaactctattttctccgtgttcagcacataaccggctggcgctttcgtttcaacaaaggcgtaacgtcccggcgcaaggcccgaagcctttacttttccatctttatcggaagtcagctcttcttgaaccgtatttccttcctcgtcgacaatgttgaaaactgcaccttcaagcttcttgccttcagcattttccttcgtcaactcaacggagcctttatggttagtagcgatcccggcatctgtagcttcaggctttccttcagaggaatcagagatctcaaactcaattttctctgtattcagcacatagcccgctggcgcttttgtttcaacaaaagcgtagtgtcccggtgcaaggcctgaagctgcgactttcccatttttatctgaggtcagtccttcttgaaccgtattaccttccttgtcgataatcttaaagacggctccttcaagcttctggccatcggcatcttccttcgtcagctcaacagagcctttatcgttaacggcgattccggcatctgcggcttcaggctttcctgctgcagattctgagatggtaaattcttttttctttgtattcagcacatagccggctggcgcttttatttccacaaaggcgtagcgtcccggcgcaagacccgaagcctcgattttaccgtctttatctgaagtcagcttctcttgaacgacctttccatcttgatcgacaatgttgaatactgcgccttcaagtttctggccttcagcattctccttcgtcagtgagacttttccttgatagttggtcattttccctaaattaacgtcggacacttgattcttttcattctttgcgactgagaagtgaatcgcttttgtatttacgataaagccttcaggagcttgtgtttctgtcaagcgatagtagcccgccggcaaaccgttcatttctacttttccgtttttatcagattttatatctgttcgtatgagagtataggtgccgtcatttgattttttctccagcttgaaaacagcacccgccaaaggattgttttgttcgtcttgtttgataagcgtcaccttgttctgttgatttatgactttgtgcagcgctcctgtcttggaggagttgctgtctatcttaacagagactccttttgcataagcatcactgatggtatatccgtcaggcgctttgacttcttttaatacataggaaccgtagcgaatatttccgaatgtaagcttcccgccggcatccgtcgtaccagtgcggaggagctgtttggagtcctcagaccataactggaattctgctccttcaagagctttatcgtcctctccagtcttaaaaatcgtcaggcttcctttttctccggatccggaaccgtcgccgcttgaaatggcaacaaagatcgagctgctgttttcttgagtctgctccttcacatttgttcctgaaatggacaccttatttttaacgtggccgctcgtgccggctatgttaatcagtgaccggtatttgatcatataggcgcggtcaatttgtttatagctgcctatgaatttcaggacaaacgattgttcacctgttgtattgtccgttttgatgtctaacgtgtagtctttgtctttttgaagctcgacatctcccgcagtcagatttccactgctgtctttgaccactccgttttcatcatattttgcttgatacactttaaaagaatccgcatctaatatttgattttcatccggcgtatcagtaacttttacgtcatccagcgttgattggctggagttgacattgatgttccaatcgatatagcttccattttgtttaccgcctttgaaaaccagacttcctccgttcgtaactgaaacagagcccgtcagtgtgcggtctgcataaccgtcattatagtaggttgccttgtttgtgtactgattctgatcaatgacctgtcctttgagtgatgtcttaaactcaatcagatatggtacagaatcgcctgttttaaggtgtaccgtcagcgtgcgttcattttttgcagaaggctcttcgacatcatacttggaaggatcaagcgcgtctccttctgtgatcgagccgtttttattgatcgtatagctcttaacgacaacggaacccggcacaaattgctgaggatctgttatggcatctttgatataagggtttttcgtcggctcgccgttatagttgacgccgattttccacgtgatttcctttgaaaccgcgttgtatgagccgtttttaaacccattatttgaagtctgatgattcggcgtaaaaccgcttgataccttattcgtgcgctcattgccgttttgatcagtccatgtcgactgagctgtattcttaacgctttcgttagaataatcggcattgaacgttgtcgtataagtgatcttaaattgactgtctgtttttgcataatccccgatcaatgccaaagtaaagcctttatgatccggtttttttattaacgtgtagtctttgtctttctgcaatgttttgttgttcgttgtgtcttgaagcttgaacgattcatcaagcagaaccattccgccgctttcaaattgatcattcaaagtccaattgttcatcaagtatttatttttattaactgtaatcgtccaatcagccgtcttcttctcataatctacgtttgaatatcctttgatgaggttttgctgaatggctattccggaagcctcttttgaatcccctgttccggtcacaacgctgttggtgtatgttgtagatttatcaatgatcactccgctgttgacctttgtttgatatgtgattttgtacgcgctggtaatggttttattaaatttgacttcaaatccgcttccattatcgatcagcgtatagtcctcgccttcctttaaaggcgttcccgcttgctcactgccgttctgtccaaaggtaataggaataaccttcaaagaatctttcacaagatgcaaatcgccagttccaaaagcatctttaatgctggccttggattggtcgatctgtttctcaccgtaattgtatgaaagagcccagctgaatgtttgagattctccatcatagccggtcgatgatttcgcgatcatttttccatatttggctgcaacagtggcttcggcagaaatgggttccaggttgtctccgctgaatgccgccttgttcgtcagcgttacatttccgccttcactcggcttcgcactattgtcaatgtcggtttcgtatacaaggcggtatgctgaatcaattgtcccgtcaaatgtgacatttccttttgaatcaacactgtagccggaagaaacttcatttcctctgctgacagaaccatcaatgttcacattgagttcatacactttaactgaacggtagattacgccatctggaaggctttccgtgagtttggcatttttgacttgatccaactttttattgacatcgaccgtccatgttactttaccagggttgatgcctttatccagcacacctgatttatcaatggttttactcacattgggtttaaaataaactgttgtttcaggagtatcggcattcacaggaaatggaatcttttgtgttgtcgaacccgttatttttttctcgttgaactgcgtattgataaccaatgtgcctttgacattagaactgtcttttacctcgccgttaaatgtcattaccacatgtccgttcgtatcaatagaaaatgtcccgtatgtggtgtctccggcgcttaaaggcaggttcacaatgtcattatgcataataaattctttaggcaaatcaaattcatatttatcgccggcattgattgtttttcctaaattgtcgggaatggcccaatcaattgaaattttcaccggagaattcgtattggcgcgattgcccttgtcatatggctttccgttttcgtccgtcaacgtcacgccagttaaaatattttgcgtgatttgtttttcttcagtttgcaagcttttgaaagctgattgacttgaggatgacactttttttgaatcatcactcttagaggcttcgccgctcttagcgtcatctgacggctgctgttcttcctctttttgatccttgctgactgaaggtgcaggtttgtcatctttcccttcctgatcacccgcagtatcagaagagtcgttttttggctcttccgcctcggcatctggtgtctcctctttcttaacaggaatgatcacctgctgggttttgcctccccctagctgaaaaagggctgctgctgtatgttcatcgccttttacatctgcagtaaacttagctggcagtgtaatggtccccttggcatcaggagaatccgcggatgcagttgttaattttactgtcatggtgctgccgcccgccggcacttgatagctgccgatgacctgatcagcagatttgatctcaccttctgcacctttatcaaatgtaaagcttttaggtatctccacattgatatcctgttcgctatctgcttttttgtcttttttcaatgaccattcatatgtcagtttcacttcgtcccccggtgttagtgccggtttgtttccttttgatccgtcaacaatctggcccttggcgtccttaactgttaccgaatcgaagaattggctgtcacttgacgttacgtccacagcctgtgctgtaagagtatagctggcgatctggctgaagaagaaaaagatggcaaggcttatgatcataacgatccgcccgctttttttcagccctaagggaaaactcctcgttctcaacttttcattcctccctttcttatctatctttcacttgccgattgatccgcgagaccataacatcatgtctcatcccccaaaaagaactgctaatgccgaatgagtttcaaaactaagatttgccatccgaaccaaactacattgtatgaaatggaactatacaatttctgtacaactcagaaatcatgtaagattgaagtgaattggagagagttgaagtttcacccaggagacatatggcgagggccttccctttaagtgcacaaaaaaaccagtgtgcatcgaaaggcaatcgacacatactggtttggagttctttaattaatttgatccttcatttgtttgtaacgctgatattcttttatcgcctcttctaccttcccgtttttgttgaatagctgcagcttgtattgcataattttatgatcgcatggctcaattttctcggcttgcaggcaaatgtccatcgcttgatgatcgttcatttcatgaatatgataatcgatcagttcataggcctttccgagccaaagctgggaaagacgcgtcttttccggttctgcccaaagataaccgtgctccattaggtaatgattttgataggacatgaaaatatccatgtgcagatgtaatgtagccgtattgagcggcggcgccccttttagtgatttttcccattcgacaacatcgatttttgcgcctgaaagccgaagaatatacccagtatcagtcttctcgatagtttggctgaaagggatctggctgaataattttcgtatttggtaaatggtggagtaaagttgggtgcttgcttttgaaacatcgtaatgaggccaaaaaagatcgattagcatttctttactgaccacatggccttgattgtgaagcaaaaataagtatatttcacgtgctttcgacgttctccacttgactggaatgcttgttttgacatcctttaaggtttgatgaaactgcaagctcccaaagcattggatggaaaaatgcgcctcggtattttctgcattttgtctgagcatattattcgttttgattcgttcaacagttgtctcaagccgcttgtatatgacaggcttcagcaaataatcaatggcattcagctcaaacgctttgatagcaaactcattataagccgtgatgaaaacgacttggatgttttcattcatcgattgaatcgcctcagcaagctcaatgccgtttacccccggcatttcaatatcaagaaacaccgcatctacagcaggagtctcaggatgctctaaggcttcaactggatcttgatacgccataatagattgaaaggcgtttgttcgttcaagcattttcttaaaatgaagcaatgccaagtgctcatcatcaacaattaacgctttcacaaaacatcccaccctatatgtaaaatcgagatatcagtaaataacttctattatatcatgacaaataacccctttatctggattctttttctttctattgtagtttttgaaattttgcacttacaatatttataaaaaggtaggaatttagaatgagcctgcttgaataaaggagctataatatgaaagaaaaattcatctttacttcaattattttcggttacgctgcattttttatggttttcattgccattgaccatttttccggaacaacgcttcctgcggcaaggcatggggtcatgaacctggagaagtgggattttcagaaggatgggaatgtacagctgaacggagaatggacattgtatccaaatcagattctgtcaccaaaagagatcgcctcagcaaaaggaaaagatcctctcttcgttgatgtccccagcaatgtgaagctagccaagcagggtatcaatgtggattacggaacgtataagctgaccatcagatcaaagcaagacaatcaggtttttgggatcagcacgtcgtttatttacagtgccaatcgcatctattttaatggacaattcattggccaaagcggcaacccttcaaataaacctgattttgcggcacaaaaccgcccatatacgagcttttttacgcttcacaagggtgacaatgaacttgtcgtacaattttcgaacttcggaaaaacgccgggatggggaatcgcaaagccaattacttttggcacccaggagcaaatagtgcgggaaaataaaatttcctttcttaatgatacaatcatgattacagcttttttcattaccggattatattttctgggctttttcctgcaaagaaaaaaagataaacatttgttgtttttttctgttatgtgtcttctgttttcgttcattattctgatgatcggaaaagagcggattatatttctcctctttccgtcaatttcattttcactgctaaattcattgagggcaatctctacagtgctcgtcagcattgcggtttttctctatctcttttttgcttacagagagattgtttcaaagcgttttattcgcattgccactgtttcttccgggctggtcttagtcacagattttttaaccgtgggttttatcggccatacctcgtacatcttacattctgtgctagccgtctcgactctggtttatattacatatatttttacgattgctgcgatccgcaaaatggaaggaagtctgtatcttactattgcatctatatcaatgagtgcttttgtcattttaaccaccatttcagcttatagcggcaaaacggctttttcctttaattcgatttattcactgccaacagttatcgctttactggcgatcgttctgctgatggcgcagcaatttgccggagcattccgtgaaaatgaagtgctgtcgtggaaattgctcagaattgaccggctaaaggatgaatttatcgccaaaacatcacatgaattcaaaacaccgctgaacagcatcattaatatatgccagaccctgctggccggcaaaggaaaaagaacgatagaagaagagaaagaaaatatgcagctcgtcatccgcatgggctacaggctgtccaatctggtaaatgacattctagatttagaaaaaataaagcagggcatgcttcaaatccacccggttcctgttgatatttatactttagtttgttcggaaatgaatttctacaatcttttatcgagacataaaaacttgaatatgatgaaccatatccctgacgatcttcctttagtgctcgcagatgaaaaccgcttccgccaaatattaaccaatttagtagacaatgcaatcaaatatacaaaagagggccaaatcacactttctgcttcaagactgaacgacaacatgatcaaagtgacagtagcggatacaggaagcggcatttcagaagccgatcgccaaaccatctttgagtcttttcagcaagccgaaaagaataaagacgatggtgccggtcttggcctcagcattgtcaaacagctggttcagctccataacggagacatttgggtcgaatcggaagaaggaaaaggttcggcattccatttcaccttgccgatcgctcaaaatgaacctgtatctgaaacaaaaaaacgccttcctgaattacaatccgagagagatctatcagatatctcatttagcacgccttattactctgagcatattgacgctccaaccatcctgattgtcgatgataacattgacagtttaaaaattttgagcgatatgcttgaaggtgtgccctacaatgtgattgctgtgaagaacggaaaggaagcattagaaatcatctcttgcacgaagcttgatttggttattttggacttgatgatgccggatatgactggtttcgaagtctgtatgaaaattcgcgaacgattcagcatggttgatcttcctgttctgatcattacagctgccattatcggccatgacaaatacaaggcttttcatgccggagcgaatgacattttgcaaaaaccttatcattactctgaatttatggcgcgtattcaaaacctgatcatgatgaaacatacagcaaatcaagccactagaatggaaatggcatttctccaatcgcaaatcaagcctcattttctttataatgtattaaacacgattatttctctcactcatttggatattgaaaaggcccgggaggtaacagaggaatttactaactatttaagaatgagttttgactttcaaaatacatcagccatcagttccttcagacatgagctttcgattatcaattcctatctttctatagaaaagacgcgattcggtaatcggcttgaagttcttttcgatatagatgaagacattgactttatccttccgcctttaatgattcagcccttggtggaaaatgccgttctccacggtgtcagcaagaaaagaggcggaggatggatcaaactgacagctaaaaaacaaagcaaaaatgagtattacatcaatgtagaggataacggtgccgggatgactcctgaaaaacaaaaggacctcttatctgcggatttcgatcgcagcgtcggattgaaaaatatcaatcagcggctgaaacatttttgcggaagcgagttgatgatcagcagcattccggatgcaggcacctctgtctcaatgctcattcatctcgctgaaacaacaggaagtcctaaagaactgaaggacacagaacgaacctaaacgaaaattgagataaaaaaagacgccgtttctaacggcatcttttttattccggcgactttgcttgctgcttcagcaggtctctgatttctttcagcagctcctcctgcgcatccaccgcttcctctgcagcctcttcttcttctgcttcttttttgcgccttaacccattcaaagtccgaatgacgataaaaatggagaacgatataattaagaagttcacaatcgtctgtataaagcttccatacttcactacagcatcgccaaacgtaaacgacaggcctgaaaagtcaagccctcccagcagcaaaccgaccaaaggcataatgatatcatttactagagatgtgacgatctttccgaaagcgccgcctatcacaacaccaatcgcaaggtctacgatattaccccgcatggcaaaggctttaaattcattccacatacaatcacctgcttttctatatttgtaaagaaaaaaagacaaatgtgccgctggccatctgccttttttcaattattctccgagggcaaaagtcagttctacttcgcaaacgacttcgccatcaactgtggcaacgccttttccgcgcccgattgtgccgcgggcacgaatgatttcaacctcaaggtgaagctggtcaccaggcttgacttgttttttaaagcggcagttatcaatgcctgcaaaaaaagccagtctgccgcggttttcttctttaatcaacatcgcaacagctccgacttgagcgagtgcttctacgattaatacgccgggcataactgggtactgaggaaaatgtccgttaaagaactcttcattagcggttacatttttatagccttttgcccgtttgccctcttcaacttccgtaatccgatccacaagcaaaaacggataacggtgaggaataatttctttaatttgctgagtatcaagcattgtcttgacatctccttcatctgcattagtatgtatagcaatcatcaaagatccaatctgtacatttgaaaagtatattatgaattaatctctttttcaactgcgctaaaatgtaaccaactgtcaatgagagccgtcaaaagttatgatatgataattatagattttaccaatagcaaagaggtaggaaaatgatttcgaagtttattgaaaaaagaatgctaaacatgttagacgagtggtattccgcaatgagcaaacgcaaaatgaatcacgtttgcacactgaaagagaaaattgaccagcaccttccgaagatcaaaaaaaacacaaaactttggatgcgttatcaattgtttcaggcccgccatcagctgctttttgaaaaccagaacggactcgattcattgttcgatgacctatatggcctggaagacaaaatggatgatgaattgaaatattatctgtattttttctctgggttatacgagatggtaaaaacagctccgaaacatgcagtacatcattttaaaaaagctgaacagtacctggccgccattcaaaatacgtttgaagccgctgatttatattatcaaaccgccggcgcctattacttgatgaaatcaccgccgctttccatccaatacgtcaaaaaagcattacacatctatttgcaccaattcggctatatcaaaaaggtaatcacctgtaaacttttgctcgccgtgaattatattgatcaagaacgctatgaaaaagctgaacagcttttcaaagaaatcattaagaaaacccagcaactacatgacgaaaacctgctatgccacgcttattataaccttggctttttaaaagcgaccgagaaaaaagaccaggaagcgcttctttactttagaaaagtattaaagaatcaagaatttgaaatgaattcaccagtctcatatcttcattgtgtgtacgagtctgtcagagcgctttttaaaacagggaacatcacagaagctaaagccgtccttcataaaggaaaagaattatctgaaaaggtagacattcaaaccatttatttaaaattaaaaacgcttgaagccctctacacatcagccgaagacccttatgagcagttgctcgaatatgtgcttgaattagaaaaaatcgaggcgtgggtggatttagaagtgctgttagaagatattacggaatactacaaaaaaaaggacgatttcgaaaaagccgctttttttatcatgcgcggctgattgaaaaacgcccattttcttattatctgactgaattgattaaaccgagcatttgatctcccattgtgatcgttctgctgttcagctgatatgaacgctgggacgtgatcaaatctgtcatttgttctgaaatatcgacattggacatctcaagtgagccctgctgcatgccgatgttttgtctattagcgccgttcagctcttcaaaagctgccgcattatcaatagagaaaaggttattcccttcggatttcagctcttgagggttattcacttggacaacgccaagattaaaccgctgaaccgcgtttccgtcagatgcggttaaggtaccgttcttattgatggtgatattcttcattgagctgtcgatgttcactgtattgccgttctcatcaagtacgggatacccatttccagtgacgagctgcagctggttggcattcgcagcggacggcgttacatacagcgccccgtccctcgtatactggcggtttccatttacatttacctgaagatactggtatggagacgtaaatgcgatatccagatcgcgatcggtcttctgaatgcttccttgatcagagactaggcgtgaattcatcatcgctccgacgccaaggcgcaagccgggcggcgtttttagggcttttgccacttcctcgtttttttcatcaacctgatcgaattgctgtctgacaagctcagaaaaattcgtatcttttgccttatagccggttgtgttgctgtttgaaaggttgctgctgattgtgtcaatctgctgctgcagctggtttaaggttgttgatgccgttagcattgacctgagcatagtttatgtcccccgtttttttcttccgttatcttaaattttcccaatttcatttgctgctttatccatacttttatcgtaagcctgaataaccttctgattcgcctcaaacgatctgtacgcttcagtcatttctgtataggcgcttgtcacatccacgtttgaaagctctgagacgccttgttttaatgaataggctacctgattatttccggctgcgcttggcagatcattaccgtccgccgtgctgtacaaatcatttccgtcccgtttgagattgcggacatcttccgccattctgacatcaatctggccggctgtgcgtccgttcgttgtcacagtaccgttttcagacacagtgaaattctcattatcaacagtgattggctggcgatccgtcgataaaatagggcgtccgttgatcgtcagctgattgttctcatttagtgaaaatgtgctgctttttgaataacggattccatccgctgtttgaaccggataaaaaagagcagctttttcattggtttccgcattcatcggaacttgattttcgatcaatgcaatgtctgtaggctggtctgtagacttcaggcttccctgtgtaaagagaggcttgagctcctgcatatatactccggtattcacggaaccgatttccgtccttgatgtcccggccggagattttgattctattctgctgagcagcatctcagggaacgcgcgcatagagccttgatcagctttatatcctgatgtatttgcgttagcaatattatttgaaagcatttccgttcttcgctgctgggcaatcattgcggatgttgctgtatataatccttttaacaaatttcccacctctaaaaatggcattttttccagttgtcatataggaacgttcgttctataataaaaactcagtattttatcctattatcgtcatttaacatcttttcgtgaaggctttttcataaaaaaacctcattctttttcagaatgaggtttgtgaaatcagcttagtttgcgtttaggaagcttgtccatattatcaagcatgacacctgtgccgatggctacgcaatccataggattttcagcaacgaggaccggtaccttcagctcttcagcaagcagctggtcaaggccgtttaagagcgcgcctccgccggtaataataacgccgcggtcaataatatcagcagaaagttcaggcggtgttctttcgagcacttgtttcgcagcctgaacaataacagcgacagattcacgaagggcttcttcaacttctttactgtttactgtaattgttcttggaagaccggaaaccatgtcccgtccgcgaatggaaatttcctcgtgacgtgcgtctgggaaaacagttgcgactttaatcttaatatcctccgcagtacgttcgccgatcagcagcttgtactcgcgtttgatataatttaagatttccatgtcaaacttgtccccagccattttaatagaagaggaggtgacaatatcgcccattgaaataaccgcgatatccgtcgtcccgcctccgatgtctacaaccatgttaccgcttggctggaatatttccatacccgcgccgatagcggcaactttaggttcttcttcaaggtacacatgtttcccgccgcttttttctgcagcttctttaattgctttttgctcaacggatgtaatattcgtcgggcagcaaatgagcatgcgcggctttgagaacaggccttttacattcagcttgttaataaaatgtttcagcattgcttctgttacttcaaagtcagcaataactccgtctttcagcgggcgaatcgcaacaatattcccaggtgtacgtccaaccattcgtcttgcctcttcgccaaccgccagcactttgccgctgtttttatcaagtgcaacaacggaaggttcattcagaacaattcctttacctttaacatggatcagtacatttgcagtaccgaggtcaataccaatatcccttgcaaacatctatttatatcctccttgaaaatctgtttcacagtaaatatccacattgtgccctaattatatatattatcataaaatatagaaaaaaagttggaagcacaataagttctttacaaatttttgcggatgttttatgaacgatttcaagaaggcaatgccaggtgattacgattgctgaacaggctctccttcgagaatttcatcttttttatatttgagctttgtcgcttctcctcctcttaaatgcctgatggatttatgataatcgagtatttctttcacttcgtttgccaagtcggggttaatttcaggcagacgctctgttaaatccttgtgtactgtacttttggaaacaccaaattccttcgcaatgacacgaacggttttctttgtctccacgatgtacttccctatcttgattgttcgctctttgatgtaatcgtgcacaccactcgacctccctaaaatggatgtgagaagtgtgaaatgagatccgtattctgtaaagagtcgttcattatgccgcttcttcgttgtatggttttaaaagtaagtttgtgaaatatgcccacgatccctcacctcaaacactctctttgttaggtttgtaacagtgtattagcattcttttgggaatatgctaaaaactcaataaggacaaggggtgaaacgaactttttcagattcagcaaactatttcgcatcactaaattttcacctttacaactatcgatcgctcctgtaaaatgaaataagcaattagttacttaggtaagttttttagaaggagaccgacatgtcctacgtcaacagacacctcattcatcaaatcaaccaaagcgcccgcctgattgccaagaaagccaatgaacagctagagccattcggcctttattcatctcaatggtcagttttatattgtttgcgtacgatcggaccaatgactcaaaaagagatttggtcctatttaaatgtggaagcgccgactgtgactcggacgatcaaacgcctggaggagaacggctgggttcagagacggcaaggtgaagacaaacgggaaaaacttgttgtcctcacaaaagaagccgagaaaaaatacgaagaaatcaatgtgaaaatgctgaaattcgaggaagagctgcttgcagatttccgggatgaagataaagaagctttttctcatttattccgcatgtttttacaacaatgaaaataaggaagtgacatacatttgaaaaaagcggatgcgatatggaccaaggattttattatggtcctgcttgtcaatttatttgtgtttgtgttcttttatacatttttaactgtattgccgatctatacgctgcaagagcttggcggcacagaatcacaaggcgggcttttaatcagcctgttccttctgtctgcgatcattacacggcctttctccggagccatcgttgagcgtttcgggaagaaaagaatggcgattgtatcaatggcgctcttcgccctatcatcttttctgtatatgccgattcataacttttccctgctgctcggattgcggttcttccaagggatttggttcagcattttaacgactgttacaggtgcaattgccgctgatattattccagccaaacggcgcggtgaagggcttggatactttgccatgtctatgaacctcgctatggcgatcgggcctttccttggcctgaatttgatgagagtggtaagctttcctgtattctttacagcctttgcgctgtttatggttgcgggcttacttgtttcgttcttgataaaagtgccgcaaagtaaggacagcggcacgactgtattccgttttgcgttctcggatatgtttgaaaagggcgcactcaaaattgcgacggtcggtttgtttatttctttctgttattcaacagtcacatcatatctgtctgtattcgccaaatcagttgacctttcggatatcagcggatatttctttgtttgctttgcggtgacaatgatgattgcacgcccgttcacagggaaattgttcgacaaagtcggaccgggcattgtcatttacccatcaatcctgattttctctgttggactctgcatgctgtccttcacacatagcggcttaatgcttctgctttcaggggcggttatcggtcttggctacggatcaatcgttccttgcatgcaaacattggcgattcagaaatctccggctcaccgctccggttttgcaacggcaacgttctttaccttctttgacagcggaattgctgtaggatcgtatgtattcggattgtttgtagcatctgccggcttctctgccatttatttaacagcggggctgttcgttttaattgctctgcttctctatacgtggagccagaaaaaacctgcagaggctgaaggaaaagtgtctattgcagaataaatttcaggctgccgggaaatcccggcagtcttttttgcatataaaaaacggcgctctctaagagaacgccgcttatagcaattattcaatgacaggccgcgcaggtgaatcaggatctaacgaaaaatcataggacgcttcatcacgaaacatcggatcggcatatatggattgctgatcgttttttgttgcttttcgatacgacgaaaatgaatcatattctttctttttccacatccatatgccgtcttgatccgcttccttgtggtacacgttatgattgaccgtatttccttcattttctgtaaaatcgtttccgataaataatctggaatcaccggcggtcaatatattcttttcaattgtgttgtttttcgtatcgtactgcagcagcagctgtccgccgtacagtccctttgtgtcattccggtacataatattgcgggcaatcagagaattgctggtgccgccccgctttttgtcatatcctccgattgaaataccggtgtacgcattgttgtacactttgttgtctgtgatctgaatggcatttgcatactttcctttgtgttcagacgttgcttcaatcccaatatcgttatcgtaaactgtgttgttcttaatttcgatatcgtgtcctccatcgacataaatcccgcccgctgagtattcatctccataagcaggattgccgtaagtcgagttttgataaactgtattgttttctacgactccgtttcgcacgtaatcgtttttatccgcggttccctcataaccaattagatcaatcccgatgttattattgttgcggaccacattgcctgcaactgtgaagccgtcgatattaccgttcagcacaactgcttcactcgctccaagcgtcagtttctcaactgtattgtcctcgattcggatgtctttcatgctgccagtcccataaactgcgattccgtgagcatttccttcatccgctgttgtcttaatcccccggatgtgattatccttaatggcgatatgactgctggaccctgatacataaatccctatagcagttgcttcctcagatgaaacagaaagatcttgaattgttaaaccgctgatggcaatgtcatgtttatcgtgaatacgaataagcggtgtttcatattcagcgtccgtaacggattcaccgctaatcacgacgttttcattttcatagtttcggaatgtgataggctttccgtccgtaccgctgtgctttacatcaagggtctcatgatacgtgccctcccgaatcatgacagttgtgccggcagcagccttctcagatgcgtgtgccaatgtacgaaacggcttttcttttgttccttcattttgatcactgccatttggcgaaacatacagataatccccagatccttcctcattcgcttttgtcttatcataaacgaaagcgaggatgacagacgttaaaacacccgccaaaagaataaaataccattttctcattttcgattcccatttcgttttagaatagatttctaaaaccattataaatgttctatttatggaaaaccattcaaaaatatgaaaatataccgtctaaatagatcttattcagcctggctgacctgcgcatgttcaaccgtttcaattgccaatgatgcaggcgggtgaacacgcatcagaacaatgtagaaaagaaaggagattagcacacctacaaaccaagatatatcgtataagctcttcaatgcaggaacatacatgccaatcagcgaaatcagcgcccctaacattgtggctgcaaacgcacggtaattgtagcccttccaatacacataccgtcctgtttcggaatacaggtcatctaccgagagctcacgtttgcgaatgataaaatagtcggccatcatcacgcctgccaccggtccaagcatgccgcctattaagccaagaaacgcatacacgcttgtcgcgctctccatcagcttccatggaaccgtaaataaagcgagcaacgctgtgataaagctgccacgtttgaaattgatatatttcggcagggcattcgctatatcataagcgggcgatacgatgttcgccgcgacatttacagagatcgtggcgatgcagagcgtgatcacggacaagacgatgacataagggttatcaaatcgcgccaaaatatcgacaacatcccaaatcggctctccgaacgcgacctgcgagccggaggtcaccgtaatacttgcgaatgcgaacagcgcaaacgttcccggtaaaccgtaaaattgtcctttgatttgctctttttgtgtttcagcaaagcgtgtaaaatcaggtatatttaagatcaacgtcgcccagatgccgatgatgccagtaactccggcagcaaacggccagaatgtttctgaaaacgtatgaaactttcctggttgagagtatatcgggcccaatcctccagcaatatcaacggcccaccataccatgccgccaaataccagatacactaaaggccctgcccacacctcaaaacgtttaatcgactccatgccgtgatgcaatacgagtaaatgaatagcccaaaagaatacaaaggaaagcaaaccggacaagtgaatgccgagaatgttccactcgccgccaatttctccccagcctggccacatattcaaaagcaaaatgttcagtgccgtgctacccgcaaatgtctggatgccaagccacatgatagctgtaaacgcccttagaagcgcggggatattcgcgccgtatatcccgtaagaagcccgaatgatcactggaaacggcagcccgtattttgtccccgcatggccgtttaaggcaagagcgccaaataggataagtgatgccgtaataatgatcgccagcacctgccaaggcgaaaggccgatcgcaattaatcctcccaccgtcgcgtaggtcggtatgttatgtatacatcccatccaaatggaggcaaagttcagtgctttccacgtccgtttttcctgtcccaaaggcaccagatcttcattgctcagcctgttggattgctgctgactctcttttactttcatagccggctcccctttccatattgtctatatgtcatcacgttatgttttttgacattagatgtcacttaatataactgaagagtcagacaataacactggctatgatatacaattttcccgtttgtatttgaacagcttaaacaagaaaaagagacagacctcagagcccgtctctttctaagatgcagttttcattaatgcagcaaatctcacagccattaacaggcttgctccgcccgctataatcataacgattcccatcatatcaaaatgggctgccgtgatttctttaccaaaaagaatgccaaggatcaccgaagacaaaatcgatcctaggtaacggcaggtttgaaacaggcctgaagtcgttcctaccatgttggaaggactcgttttcagcatcgctgcctgaagcgcgacattgcccagtccgtagcctatacccaagagcgacagaatgagccctttaccgatgatctggacattgataaaaaagatggttaagagcacggctccagccgtcatcaaaagcgctcccgcaaagatcggcttgacgacaccagatcggtcgatccatttgccagttagaggtgacacaacgatgctcattccagacataaacagcataaacaggccgctcgtttgaacagaaagatgcatttcatcctgaaagtaacttggcaaaccaaaaaataaacaatagaagaaaacattcaataaaataaactgaacatacacggctgacaggtttcgctgtgttttaaacagacggacatcaataaacggcttatccgttttcagctcgcgccagacaaacgcacagagcagaagcaagccaagcacaccttcaaccgcatgcggcgacgtgctgaacgacagcaaaaaggatagaaggaaaatgattcccccggcaaataaaacaattccaagaatgtcgagctgccgaataatggttttgattcctgccccttttttctgatctttcgggaacatatacaggcccaataagaagctgaggataataaacggcaaattaacgataaagatcgccggccagcctccccatacaatcaaaaacccgccgactgtcggccccagcgccgtcatggcggacgcaaaaatagagagtacagccaaggctgaagcttggcgctcatgaatatgattccgaatcaagccgacacctgacggataaatcgcactgctccccaccgattgaaacagccgcatgaccaataatgtcataaacgtcggcgcaaacggcgccccgatggcagaaaccgcaacaagaataagcccgaataaaaacaagcgtttccgcccaatcaaatcaccgagctttcccgttacgggctgcgctacggcactcgccaagtaaaacgaggaaatcagccaggaaaccgttgtaaacgagaggtgaaactcatgctggatgctatggagcgcaagagagatcatagacgagttcagcggattcagcattgttcccgaagccacagctgttaaaaaaacagcccggctttttttcgataacatcatttcacttgttccagaaactcttccgttgtccgcgatttaccgattctcgggaaaataaagcgcagtgtggcttcatgctcttcatcgctaaatgtggacatggcatctgtaataaaaatctgctgatagccaagctgaaatgcctcccgtgctgtgctttccaccccgatattcgttgcgatgccgcacaatacaatcgtatcaatgccgcgacgtctcagctgcaagtctaaatctgtgccaaaaaaagcaccccattgccgttttgtcacagtataatcgccatcctgcacaccgatttccggaacaaattcggcccagtccgccggcatttcccctgaacctccctgcgcaggctcatccgtttgcggcttcagggcgtccgctccatcatgaaaggccacatttacaaagctgatgaacccgttatgtttccgaaattcatctacgagctttttcgcgttcgggacaacctggccgctttgatcaatcggcacaatccccttttgtaaatcaatgataaccaatgctgttttttgaaaatcaatgttgagtgtattcatcatacgtctcctcctgatactgttagtgtttctcacattgcatattttactcttcacactgcctaagttcttttatgatgcttgtgaaattctcagaaggaacgttttctcatgatttttcttttatgtagtagtaacaggttgtgcatacgaacaaaccggcaagcactgtaatcataaggggcgtcatcgcttcatcacctgcctgctgtctatcggttcctgcctgaaaatgcccatgaatttgcggcggtccatccaaagcaggataagacacataaccattaatatcgtgctaagatcctgcacgccaatatcaaaacaatagttaatcaagacgatgttcacaataatgggcataaaaataaccgcccctaatgcagccgttcgcggaatcagtaataaaacagctgccaggatttcaccaaaacctataaacagttcatagacatgagaataaccgaaaaatgtccacgcgatcgtaaaccccttcccggcagccgcctcgatttcaggcgtcacctcgccaaactggccaattaccactttcgccagaccgtacacgaaaaaattaaaggctaaaaacaatcggaacgtcgcgggaatcgacttgcgtaccgctttcctcagcctgccgcctttcttcatcatacatccccctcagtgtattatttgatatagtacacttaatacagtatagagtattctaattaatgtcaattcccttttcagctcatatgaatagcttcttttatagatacaaagtcttatatcgtaaaaaatgccgttctcctttctttccgtccctcgataacattccttaaaaaccatgtcaggaaatcttacatgaaaatgttttatcattcttttttctctataatgaagaaatataataattgctttttattctgaaagatacggaggaatgagacatgcaaatgggcgatacagtttttatgttcttttgcgctttactcgtgtggctgatgaccccgggattagcgttattttatggaggaatggtaaagagcaaaaatgtgctgagcactgccatgcacagtttctcttccattgccatcgtttccatcgtttgggtgctgttcggatatacacttgccttcgcaccaggcaattcaatcatcggcgggctggagtgggccggcctcaaaggggtcggatttgatccgggagattacagcgataccatcccccactcgttatttatgatgttccaaatgacgtttgccgttctgactacagcgattatttccggggccttcgcagagcggatgcgattcggcgcttttcttttattctcggttttatgggcctctttggtttacacacccgtagcgcactgggtatggggcggcggctggatcggccagcttggagcgctcgattttgctggcggcaatgttgttcatatttcctccggtgtggcaggacttgttcttgccattgtgctcggcaaacggaaagacggtacagcgtcttctccgcataacctcatttacaccttcttaggaggagctttgatttggttcggctggttcggctttaacgtcggcagcgctttgactttagatggtgtagccatgtacgcgttcatcaacacaaacaccgcggctgcagccgggatcgccggctggatctttgtagaatggatcattaacaaaaaaccgacaatgctcggagcggtatctggggcaatcgccgggcttgtcgccattacgccggctgccggatttgtcacaccgttcgcttccattattatcggcatcatcggcggagctgtttgtttctggggagtattctcgcttaaaaagaaattcggatacgacgacgcgcttgacgcctttggcctgcacgggatcggcggcacatggggcggaatcgcaacaggattattcgcaacaacctctgttaactcagcgggcgcagatgggttattttacggtgatgcaagcttaatctggaaacaaatcgtcgccatcgccgccacttatgtttttgtatttattgtcactttcgttattattaaatttgtaagcctcttccttccccttcgcgcaactgaagaagaagagtcacttgggcttgacttaacgatgcacggggaaaaagcatatcaagattctatgtgaggagtgacgctatgagcggtcaaatgttcaaggtagaaattgtaacgcgtccggcaaattttgaaaagctgaagcaggaactcggaaaaatcggagtgacctctctgactttctccaatgtacacggctgcggccttcaaaaagcacatacggagctctatcgaggggtaaaaatagaaagcaatgtatacgagcgtttaaaaatagaaatcgtggtcagcaaggttcctgttgatcaagtgacagagaccgctaaaagggtgctgaaaacgggatcaccgggtgacggtaaaatatttgtctatgaaatcagcaatacgatcaacatccgcacaggcgaagaaggacctgaagcactttaatatcggtacgagattcggacactccggatctctttttttgtgcacagaatcccccagaaaccgcgattcctcttcgaattctcttcaagcgccgttatttcagacaatctctatttttatttgaaacttttcatgagtaagattagtctactaaatataaaaatgtaaaaggtgattatttgaactacgaaatttttaaagcaatccatggactatctcatcacaattcagttctcgattccattatggtcttcatcacggaatatgccattgtcgcctatgcccttatcctattggcaatctggctgtttgggaacacacaaagcagaaaacatgtgctatacgcaggcatcacaggaattgcaggccttgtgatcaactatttgattacgcttgtttatttcgaaccgcgcccgttcgttgcgcatacagtgcatacactgattccgcatgctgcggatgcttcatttccaagtgaccatacgacaggtgcattagcgatttctattgctatgcttttcagaaaccgcaaaatcggctggccgcttgtcatttttgggctattgacaggcttttcgagaatttgggtgggacatcactatccggtagatgtattgggcagcctcgttgtcgccatcattatcgggttccttttctttagattttcagatctgcttcgccagttcgtcgatttgatcgtgaggatctatgaagccatcatcaataaactgacgaaaaaaccaaccgatcaaaatttctaagaaagacaaaagccggcgtatgaaatcaagacagccggctttaatatttctcatacatctcttgttttcttcgcttcgccaacacatataaaccataaaacaacccaattccaacagcatcgatgagcacatcccggatacaaccattcctgctgaagaagagctgaagaacttctgtaaaaaaagcaaacgcgaatgagccggctgaagctgatcttatactgccccgctgtttccacagcaaatatgtcagcacaaagaaggaaaacgcatgtccgattttttgaataaacgcttcagggacagtaagctcagtaaaatccataactaaaaattgagacagatcagggtgcggctgaaaatgaaaagccaccgtttgcgatacgaccatgccgctgaagctttccgtacagacagaaagcaggataaaaaagatccagcctgcgagcaatagcaataggcggttcatgacataacctcctttataacgtacgtgtttacatgtaactacatagacggtaaaacaaagcaaaaagtaacagaaaaaaacgcccatcacaaggatagacgttttcttcattaagactgttcagtgtcttctgttgtgctgctttctttagaaccagatttgtcagttgaatcatcctttttctcaccggatttttcttctgttcctttttcagttgatccgtcctttttctcggaagattgctgaatggattcttctgtttcttgggtggcagctttttcttcagcagctgctgctttttcaatagaagaaactggtttgtccataaagtttaacggattcattgcgaccccatctttacggatttcaaagtgcacgtggtttccgctgtcttcactgtaaaggttcttgccagattttccgatcacttgattttgttttactttgtcaccttgctcaacgcttacttcggaaagagattgatacacagtcgataaaccgtcggcatgttctacttccacaacatatcccagcactggatctttttcagctttaacaaccgtaccgctcagagaagcagagacatcgaaatcttttccgtctttctcagctaagtcaattcctttgcttaggctgtacgtgttattataggtaacgagtgctgcttctttctcttcttttgcggcatcggtttcatagaactttttcacaacagaaacgttttcagaatcaacaaccggcattgcgacattttccattgactttcctacttcaactgcatcgtcgttgttgtcatatgcggagtttccgccgttatcagccaactgatcctttacctcatcatttgatactgattgataccaaaggacagctgttaaaatgacggccgcactgactaagtaaattgcagggaacacccagcgtttacgaaaaaactgctgaagttttttgacttgagaagttttcttttcttcctctctcattgtttcatcacctcagcaacattctgaacacttttctgaaaatatatacaacctatccaaaaaaacttttttagatgtagtttgcacagactgaacgaaaatatgtatttttttgagaggagtgccaaaaacgtatgaacatgacattgcgtcttgctaaacatagagacttggaggctgttgtggcgatttataattcaacgattgcttctcgaatggtaacagccgataccgaaccggtaactcctgaagaccggatggaatggttttcgggacatacagagtcacgtccgctctatgtggccgaggatgaaaacggaaacgtcgctgcctggatcagctttgaaacattttatggaaggccagcctataataaaacagcggaagtcagcatatacattgacgaagcatgccgcggcaaaggtgttggatcatatttgcttcaagaagcgctccgcattgcccgaatcttggcatccgctcacttatggccttcattttcgggcataataaaccaagcctgaagctgtttgaaaagcacgggtttgcagaatggggactattccccggcatcgccgaaatggacgggaaaagatacgatttaaaaattttagggagagagctttcatgattagtctggataaagatgaaaacgaaattgaaaatcataatgaagaaaatagccttgttgaacaggagacccgccagctgagcgcctccgctgtcaagtcgctatccgacattgccaagtggggcaaaatttctggcatcttgttaatcattatgggatcgctggtcactctgaccgccttgatgacagtgattggcgccatcccgggcgtactgctcattatttcaggcgtatttttgatgcgctcagcaaaagcagccgcggaagccgacggaactcttaccggcagcgctggcgaaagcatgcttgaaaattacgggacatttataaaaatgcagctgttttatgcagcatccagtatcgttactgtcctgatcgggatcattgtagccattttcgtgctggtggtaatcggcattgctgcttttgagaacacgccttcgtatgatgatccggattcttattattatgaggatgatccggtgtttgaataatgatgagacaggacagggcatgagttccatataaacgggaccatgcctattttatttgactattcaaagcaggccggcgtaaacaccaaatcctgaagcaagcatacaatagacatctctagtagaggaaatcaacaaagcaacgctgttacccagaaatgaatatcaaaaaaacggatgaagtcggaatcaatccgaaaccgcactttttatttcgggtgtctgcatgcaaaaaaacacacccggatcgtctggaaaatctcaacaatccgggtgcagatcttctttaatacatttttttgcgtctgtcttcctcagtcaaaaattcaacaaaactccgcatcgcaaaaggctcttcctttatttgtcgtgcgtaggagcttttccgctcttctgaaaggatttcgctctttttgatcctgttcagcatatagatgtgaaccgttttttggatttgtttatgctgatagcctgcctctttaaaaatgcgagcccgagcgccgccaaaagggcgaatatgcctgcgctgatcagggactccctgtcagctgaagcatgaaatagaaaagcagctaaattaaagagagagaatgcagcaagcggaatagcaagaaaacggtaaatgacggtttttttcataaaaggctgtacggccttttgaattttttgcatttctgttttgatgaaccccggcatttgttcgactctgtaaaagttcatgtaatcctccccctttatttgatgtttcaagcttcacgaacgttatcatatgtgtttattttaacgcaggtgcaagctggttttaaagaaatctgcccgtatttttcacgaagaatctggatcgccgctctttattcttttaaaatgtgagtgttataatttgtaatgggaatcagatcactgttattcatggaatactaatggcaatcttcttgataaatatgaatgagcggggttacaaagtgagtatttcttccatccttttatcactttttttcattttaaatattcttttggccatcattgtcatcttcaaagaacggcgcgatgccagtgcatcttgggcgtggctgcttgttcttttctttattcccgttttaggctttattttatacttattattcggccataatctcagacgcaagcatttgtttcaatgggaagaccggaaaaagattggaattgaaaggctgctgaagcatcagcttgaagatttagaaaccaagcaattccagtttaacaaccgggcaacctttgataacaaagatttaatttatatgctgattatgaataaccatgctgtgtttacagaggataattcagttgacgtcattacagatggacgggataaatttcagcggctgctgagtgacatttcaaaggctaaggatcatatccatttacagtattatatttataaaggcgatgaattaggcaaaaaattgcgggacgctctcatccaaaaggcgaaagaaggtgttcaggtcagagtgctttatgatgaactcgggtccagaacgctgagaaaaaagttttttaaagagcttcgcgaggctggcgggcatgtggaggtctttttcccgtcaaagctcaggccgattaacctgcggctgaattaccggaaccatcgaaagcttgtgatcatagacggtatgaccggttatgtcggaggctttaacgtcggagatgagtatctagggcttaatccaaaattcggttattggcgggatacgcatatccggctgcaaggaacggccgtgcacgccatccaaacacggttcatccttgactggaaccaagcttctcatcaccatacgctgacatatattccaaatcactttcctgattacggcccaaaaggcaacgtcgggatgcagattgtcacaagcggccctgattcggaatgggaacaaattaaaaatggctacatcaaaatgatttcaaacgccaagcgttccattttgatacaaacaccttattttatcccagatgcaagcctgctggatgctttaaggatcgcttgcctttcgggcattgacgttaacattatgattccgaacaagcccgatcacgcctttgtatactgggcgacactttcgtatatcggcgatctgctgaaagccggagccactgtctatatttacgataacggctttattcacgcgaaaaccatcgtggtggatgacgaaatcgcgtcagtcggcacagccaacattgatgtccgaagcttcaggctgaattttgaggttaatgcatttatatacgatatcaccattgctaaaaaactggtttcaacttttaaagaagatttgctagtatccagaaaattcacctatgaggagtatctgcagcgctcgttgtggattcgaataaaagaatccgtctcgcggctgttgtcgccgatcttataagatgcgccaaaaaccccggcctttacggccgggggttttcctgatggtcacagtaaatgatgatcgcgtcccgcaaaaaagcggcaagaccttctccatattgattgattgaatcggtaaatcgctcgtcagtgatatacacttccccgagtcctctgaaaatgtcgagtgtgcaatcgtaatgatattggcaaatatgatcgcgaaatgcccccacagcggcctgaatctctgcatcatcgggcccatgcttcattcgcaccgcaattcgtctgtaaatcgaatcaaattcagccatgatcgagctccaatcatctgccgagtatgcagatgtccttttctctgtttcttctgtgatttccttaccatacagctttctgacttcatcagcgtatgtctgctggtgctcttcaatgtctttcatgcttaatccggcaaataaatccctcttattcatcgtttcccctccatcaacggacaaaagcgtcctgtcaattgtttgaatcatctcatccattctttgttttttcttcatcaatatctccttttgcgactgaagtgccgctttccggtcaaaattcggatgatccagcatctccttaatctcatccagacgaaacccgatttccttgaaaaataaaatctgctgcagtctttccaggtctgcgtcactgtacaaacgatacccagcatcagtaagcgctgaaggattcagaagctcaatattgtcatagtgatgaagcgtccgaatgctaacacctgatatctccgccacttgtttaacttgatatttcatacataacacctcctcttttttatcgtaaacaatcacgcaacgttagggtcaatccccaaaatgttattttccatatacaaaacttctcacaaatagtgtataaaagaaaagtgagtatttttttgtaaaggggagccagtatacatgaatcctgaaacaatgaacaaaaccctcatcagcatttcgaaatggggaaaagctacaggcattttatttattattatgggcgcaattaccgcgctttcaggcgcgttcttttttctaatcggtgccgtgccaggcgtactgcaaattatttccggtatctttttgatgaggtcagctagggaagcaggccaaatggctgaacacaatagcggacagtctgaagacttaatgctggagaattacgcgaaattcgtaaagatgcaagggatttatttgatcgtaagcattgctgtatccattcttgcgattatcgccttcttcatctttttaatgcttgggattgctgacggccttttcagcgatacgtacagcacttattaatgagaaaaacccggagctggctccgggttttttattattccgcttcgcttaccactgtgaagcgttcatttttgtgttcgggatgttcaagctcgtccaacacggcaatggcataatctgcatagctgatatagctgtcgccttttgcatttacgatgacattgtcttttcctttttggtaagagccagtccgttttcctgctggatcaaaaaatgccgcaggactgaggaacgtccaggaaatggagtctgtctgctgcaaatctttcaggttctcgccttgatttgatgcagttggcaaatattccttcggaaattccggcgtatccattaaacgggttgttttggcttcatcaacaaacaggcttcccgctccgccaacaacaagcaatcttgtgtgcttcgcgtcctttaaaatgctgatgagtgctcttcctgcttcaacatgaagatgttcttggccgggtgctgctccaaaagcgtttacgaccgcgtcgaaaggcttgatgtcttccgcagtcagttcaaacacatctttttccaaaaccgctacgtcctgctcctgcacttttgaagcgtttctgacgatggctgtcacttcatggcctcttgttttcgcttctttcaaaatctcgtttcccgctttcccgcttgcgccgataataccaattttcatttttcatttcctccttatttgtaacaattttagttacatgttagtggtgagaagtcatcccttttgattaaaagagatgattcataacatcttttaatgacttgcttgccagttcattttccatcgctctttgcacactttcaaacgtttcatccagagcgttctgaatttttttccctaccggacatttcggattcgggttttcatgaaccgcaaagagttcttcttgcttttggacagcccggtacacttctaaaagagaaatatcagcaggatcttttttaaggcttgcacccggcacccctgcgcgtgatgtgagaatatcagcttttttcagcaggctgatcattcttcgcacgactactggattcgtgttgacactgtctgcaatgatttctgaagatgtttttcatccatcgagatgagggataaaatatgaatggcaacagcaagacggctgttaatcatgttttttcaccaccgttgtaactataatagttacatttgattcgtttgtcaacatctaatatacactaaatacatgggttttgtgcaccgtttttagtcaatagaacggccggatgcactccggccgcgtcttatcagaataagaaatatctttgtccaagggggacataatcgacaggctggcaagacaattcctccccgtcagcaaagacctgataggtttttggatcaatctcaatcttcggcaaagccgagttcagcttcatatccagcttgctcagctttctgatatttttgactggagaaatccttttttccagccctaagctttccgccacaccacgctctatgcttgcctgagacataaatgtaatcgaggttgaacggttggcttttccgtaagacgcatacatttggcgcatgaaaaccggttcaggagtcgggatggacgcgttcggatctcccatttgcgcacgtgcaatcatgccgccctttaagaccagttccggttttacgccgaaaaatactgggtcccacagaacgagatcagcaagcttccctttttccaccgagccgacttcatggctgagcccgtgcgtaattgccggattaatcgtgtatttggcaatgtaccgttttgcgcgcacattgtcatttccgttttcgccggcaagagcgccgcgctgctttttcattttatcggctacctgccatgttcggatgatcacttcaccgacccgccccatggcttgggaatccgatgatgtcatgctgatcgcaccgatatcatggagaatatcctccgcggcaatcgtcgccgccctgattctggaatggctgaacgccacatcttcaggcactttcacatctaaatggtggcagaccatcatcatgtcaagatgctcatccatcgtattaacggtataaggaatggttggcgttgtagatgacggcagaatgttcgcgtaagaggcgagcttcataatatccggggcatggccgccgcctgcaccttcaatgtgataagtatgaatgacccggtccccgattgcgtcgagcgtgttttccaaaaagcccgcttcgttaatcgtatcggtatggatggcaacttgaatatcagcctcgtccacgacttccatacacgttttaatggcgcttggcgtcgtgccccagtcttcatgaagcttaaggccgatggcgcctgcttccacctgctcgatcagcggcgctttatcggatgcattccctttccctaagaagccgacattgatcggaaactcctcggccgcttccagcatccttgccatataccacgcgccggatgtacaagttgtcgctttgctgcctgtcgcgggtccagttccgcctcccaaaagggttgtcacacctgaagaaagcgcaacttccatctgctgaggacaaataaaatggatgtgcgtgtccactcccccggctgttaaaattttaccttcaccggaaatcacctctgtccccgctccgatgaccatgtgcggatcgactccatccatgatatcaggatttccgctttttccgacaccgacaatccggccgtctttcacaccgacatcccctttgacaatgcctgtgtaatccaatagcacgacgttggtgataactaaatccaaagcgccgtccttccctgtgattctgccgttttggcccataccgtcgcggattgtttttccgccgccaaagatcatttcttcaccatatactgtgaaatccttttcgacttcgatccataaatccgtgtcgcccaatctgattttatcgcccgttgtcgggccaaacagttccgcatattcctcccgtgacattttcatcggattacaccctccatccagccggcttgttttaagttggccaacgttttttctttgccgcgttcatcgataaacgtgtcggccattccgttcagccctctaattgtcttgcgtcctctgatttccactagtgagaccgttttctgctctccaggctcaaaacggaccgacgtgcctgatggaacatcaagacgcatgccgatcgccagctcacggtcaaataataaagccccgttggcctccgcaaaatgaaaatgcgaaccgacttgaatggagcgtgatccggtgttttttaccgttacctcccgtatctcacggccttcattaatcgtaatggttccctcagcaatttgaaatgctcccggcttcatgacttcacctccgcagaaattggctgatgtaccgtaacaagctttactccatccggaaatgtggcctccacctgaatgctgtcaagcatctcaggcaccccctccatcacatctttttccgttaatacatggcggccggcttccatcagctctgctactcccttcccatcacgtgcgccttccataataaagcaggtgatataagcagcagcctcaggatagttcagcagaacgccccgcgcctttcgctgtttggctaattcccccgctgcaaaaatgagcaatttctcttgttcaaccggtgtcagtttcatctgtagtcctccttcttttgtcatataaagcagatgcggctactacgaatttgcggaacagtcaggcgggacatcacctccctttcttcgagaatgggggtcatacggtaagatgcctttcaaagcggcatgccgtttcttcatcagtcttgccatggtcaacaaccgttcccctgtcgatcacggaaagatagtcagcacagattaacacgttttccagactgcgctcgaccaagataacagaaatgtctttttttctggaaatttctataataacttgtctgactagttcgacaattaaaatctgaattcctcccaattgttcattaagtaaaatatttttcagatttaccatcatcgctctggcaattgcaagctgctgctgttgaccgccttttcgttttgaacaaacgtttgattaaaacaaatagcccccctgtttagccggagtcggcctaatacagcaacaatctgccccgggtgaacctctatgctaaggctgtgctaaaccatcgattaatcataaccagacgttacattcctgatggcagcccgttgttttgctccgcaaccggaagcatggcatggaagccagtctgaggcgccgtcctccacgataccgagaacctgactattgccattaactccgtatcatggacggtcacttcgctgatcgccaccgttcctcttaacgagtgaagaattccggccttcactgaatccccgcttgtgtcgatatcaactgttttttcgcactcccgtggcttccgacactttcttcgatgcagtacattccgtcatccaaacccctttgtttgatttcttcaaatgatgttataaaagtttacaacttatgtcattattatatagaagaggcctattaattcaaagaatatttaaaaaatttagttacattgaccaaatcagcttctttttttgttatatttattcacatcagaaaaagcgaacaaaaaaagacaagaaacatttcgtttcctgcctcttccgtacgattaatctttatctgaaaatttatccttggctttcccgatatccttttggatttcgcctttcgccttatcttttttgccttcagcctgcatgtccgttctgtcagccatatctccgactttatccttcacttctcctttggctttattgaagccgcccttcattttgtcttttacactatcgttacccatgttaattctcccctctcaattatgtgtgtacttgttaccttcccgatctgagaggcaataaacattctaatgttatttatcgatttcgtagcgctctccgtaacggagcaccttgtatatcgccagcccgtctgatgactttttctccgaatatcggaccggcagcagggcaaaaaacacataatacgtagaaaaatagacaaactgatagaaaaacacattcggctttaatacactgtgtataatcagcagattgattgcaaaaatcgtgatgaggttaaacaagcagccccctgcatacacgagtgcatttgagaatcgattgtcaattttcaactccccgtaccggcaaaaagaatcgataaaataaatcgttctgaaccgtatgggtccaattttaagcagcgtttttcccatgcctatatccaacgatccttttccgccaaaaataaaagccataaagctgtgccctgaaacatgtataatctgtacaagcggcagaacaatgaggaaagaccacagaaacttcaccatatcattaaaaccaaacattgaattccccctcacgtgcagatgcatcccaaaacggcttttgttcaaaaaacagtgctgtagcgatttttcctgttctccccggaaataaacgttccgatgctcccctttttttgcataaaaaaaccatctgcaagcagatggttttgtctcatacttcatataagcaatcgttcctttgaatcatctctctcatgctgaccgctttttcataaaaatacaccgcttctctatattgttcgcgatgactgaaataggaggcagcatctaaagcaaattcttcaatatatacgtacaggcccttttcttccatataatcaaatacttcttgaatcatatccaaattgacagattccacatataatgcctgcagaaatttatattttgccagactgaagaagtcgtttcgtttttgggcaatggcaatccctttttcatagtaccgcatcgcggcttggctatcttgttttttgaaaagaacgcgagtcaggctgaagagcgcttttggaagctgttccagctgataatcctcgaagacaggaagcgctttttcaaagtattcggcggcctgatccagctcccccttgtcatcatagcaattcccaatgttataaagggctgatccgattaaacggggctgtccttccaataaagcaaggcgatacgcgtcatctaaatgttcaagcgctttttcataatttctgtagtcaatgtagtttcctgatatgacgaaatggcattgaattcttctgactctgtaaaaatcgtgagccttatacgtctccagcgcctgtacggcgtggttcatggaaaagtgcgtctgcttcataatataaaagacttccgccactttaaaatgaaattccgctctttcaatttcatcttctacaaacgcaagcatcttctcagctttccgataaaaggatatagccgagatgtaattgttctgttcaaattcgtacattcctctaaacaagtgaaaataatactcagataatccggagatgctgtcctgattgctttccagcgttttgatcaattcacgatattgaagctgagattcctcgtgcaggtcaggctttacataatccagcataatttggtgccggtagctgatcagctgataatacaggagaagcagctgatcctcttccatctgttctatatctagatcaatttcttccttcagctttacggcatcagccacttgaaatgctaaaatgtgcttataccacttattgattttcactcctacttgagatgacgggatctcgtacgcggccatgcccctccaaccctttctaattttctaattggttatattttatcataatgtatggctttggaattaaattttcttacaatgattccttctttatgcctatccttatatatttcggtttttatacgtcttttttgcactcggattctaataaaaaagcttaccggacagtgccgataagcttttgacttcaaattaaccgccaatataagacatttccactttctttttgtcagatgcttttgatagcgcacgatcgactgaatactgatcgatccgatttttccatactgtcccgatcatttctgatagttcgtcatcacttaattcctggcgaaccggagctctgaggtcaaatccgcttgaagcgaataagcaggtaaacagctctcctctcgcagaaagacgggctctgttgcaagatccgcagaacgcatcagatacagatgatatgacgccgatttctccggagccgtccaagtagcggaatctggaagccacttcgcctatataattaggagctatcggctcaaccggcatgtgttcattgattaaatctatgatttccgcctttgtcatgacgtctttcttttcccattggttggtgttgcctacgtccataaattctatgaatctcaggatatgccctttttctttaaaataacgggccataggcagtatatctttttcattgacgcccttttgaacgaccatattgattttaacaccgagccccgcttgcttcgccgcttcaatgccttccagcaccttgctgacagaaacaccgcgcccgtttatcttcttaaaacgctcgtcttctaaagaatcaaggctgatcgtaacccttttcagcccagcctccttgagcctctttgcataaacaggcagcagtgatccgtttgtcgtcatcgcgatgtcacgaatacccggtatgcgggccagttttttgattagttccggcatatcctttctcatgaggggctctccgccggtcaagcggattttttcaacgccaaatcttgtgacaaacaatgtcgcaagccgttccagctcctcaaatgaaagcagctcctctttctttaaaaaaggataatccggaccgaataattcggcgggcatacagtacgtgcatcggaagttgcagcggtctgtaacagaaatgcgaaggtctctcagcggtctgtttcttttatccaacatctgacgcgactctgtaatcatagctacagccccttcctactccctgattctctcagggtgtgtatatacattaaatgatccgtttctgacaaatccaatcgctgtgatattcaattcttcagccatttgaatcgcaagctccgtcggggccgatttggaaatgacaatcgacacgccgattttggccgcttttaacaggacctctgatgagattctgccgctgaacacaatcagtttgtcgcgtacggacatcccgtttagaaggcagtgtccgtatagtttatcaagtgcgttgtgccgaccgatatcggtgcgcatcaacagaagcttctctgtgtcgcaaagcgccgcattatggacgcctcccgtatcctgaaacgtcccgctcccttgctgcatgtctttcataagcgccagacatgcctcaggcgatatcttgatttggctgacagccgtcttggctgttttgacatcctgctgaaaataaaaatgacggccctttccgcagcatgagccgatcacccgtttcgtataatccttttgatccaatgtctcagggtgaacgaggtcgacatatacaaaaccgagactttcatctattgtaaaccttttaatttctttttgaaatcgtataacaccctctgatgcgagaaatccgatgacaagctcttcgatatgctcaggcgtacaaacgagcgtcacaaattcactgccattcagtatcactgtcaaagggaattccgtcaccatccggtcttctactttgcttatttccccttgttcatagcgccatacatccctgaccgcagttactttatcgttcaatgtctcttcccctccgcaatgttcctgcctttatattttttcacactcctcggattttgtcgaattctgagacacaaaaagagccctctatataaagggctttcacaggatgtgatgacggcggtgtttaggcagggcgcctaagcatttagccaccattccttttaccaatgtgcattgacaacgaacgcggggtttgtcgacacgctgagagccctctatagaaaggactctatggttgattatactgattctttttcagaaccgtaaacagcacaatagctgcgatcaaggtgagaatgctgacaaaaaagaaggctgccagttttagaagaacaccaagcaatataaatgcaacggtggctataagaaaaatcattcctaataatttcatatgttcaacccctttttagggtatcattcccgcccaaattgtttttaaaccaataaaaaaaggcgcctgggggagcgcctgatttttaggttccttactcagtaaatttttgtgcttctttttcccaagcctgttcgaactcatccgcactgttcgctgaaatatattctccgccgccagcgacagctgcttgtttcatctcttcattacccttgacatcaaagttgaagccaatgatgtttacaatcgtatccacatttgatgcacggagcttttcgatttccgccgcagggtctccgccgcacgtttcttcaccgtcagtgattaaatacaccacgtttttcccgtctgcgtcaaatgcttcaaattcttttcttgtgtctgcaagtgctttggctatcggtgtccatccagtcggcttgagctcactcaatgaattgtcaaacagagacccttcatatggatgaaggccgtaaatggtttccgttgtactgcacgaaagggctttaccggacagtttattgttccctgcatgcccgaaaacgcgaagcataagatttgtatcctttggaagaagttcggcaaaagattttactgatttttttgcaatgtctattttgcgctctcctcctgttttttgaaccatgcttccgcttccatcaaacaaaacagctacatttgtatcagcctgtttctcagcggcaaaagacggggaggcaatggaaacagtcaacaatccaatgataccggcagccagcaattttttcatatgattacttcctttctttttcatattttccaactatatgttggattcttctttatgctagaatacgaaaatgcaaaaagatataggacatgctgccttttgtgctgctttcacgatctgtccaaaatcgcttgaaatgccgttcatttttagccatttccgcccagaaagcataaacagattgtgtgatcattcattcttttttcgccttgattatgacagaaaaacggaaatctgctactatgctacaggctgacagctaattagttttgaagtttttgttacatacaaaaagaggctgaccatcaccagcctctttttcttatttagataacattagtgattgctgagtgaaaattttctcaacatctttttgggtataagccgggaagtattcaccgccgcctactttcgcaattgcgttcagctggcctttgtatccctctttataatcaaagccgatcacattaacaatgatattgtctttttgcagttcctttgctgttttaatcgggtttcctccgcacgtttcctcaccgtctgtcagcagatacaccactttttccccttttgcatcaagctggtcaaaagaagatttcgcctcgttcagcgctttggcaattggcgtccagccagtcggcccaattgtattgagagaattgaggaagctttgctcattaaagctttggaagccgtatacgttgcgaatggcttcacatgactgaacttttccggaatttttattgtttccttcagagccaaacacgctcattttcacctgagttccttctggcagtgagctcgcaaactttgaaatttcttttttggctgaattaaatttagagacaccgtctattcttttcgccatacttccgctggcatcaagcaagaccgccacgttcgccggcgctttagcctccgtttctgtcttttcagctgcaaaagcaggtgaagttaatccaaaaagcaatcctgtcatcatgatcagtgaaaatcttttcttcatgttcgtacccctttaccaatttgtttctgcgtgcagatgttcaacgctgaacataatctatcgtaatcaacaaaaaccgagaaataaatagggcgggcttccccattgctgttgtttacttttgcatagaaacctatgtttttattagtgatttccacctaacgcccctatgaaaagagaagattgtccgcctttcggctttcgttatatgagtctgtcgaagtctgtcgacaaatgtggatgactttaccacaatctcaaagcctgaaatcaggaaaaaaggactgatccttaaagacggtcagaagctcctctaaaccgtttcagctgctcttagataaaagatattcaggaacagaaaaagacgcccaatgagcgtctttttctactttttcgccatatatttattcaaaaacgcatctgcctcagaaatttgtgtgccttggtaatagtactttacaatgtcatcaaccgttttgccttctttggccataaaattcgctccgtattggctcatcccaacaccgtggccaaatcctctcgtcgtgactgtaattgtgtctccatttcgcttccattcaaaatcggcggagttgagacccagcttttcacgtatgtctcttcctttcagcgtcttgccgttaatgacggcagttgcgacctggtggcccggtgtctcgccggtaatcttccctactgcgctagatccatccagcttgacgccaagcttttgctgaaattctgccgctgtaaaggttttcgttgccttatatttcggagactttttatcccatgggcttttgacgctttttaaatatgggatagcacttgtccaataagcttctgcattctctgtgtagccgttgcttgtggagaaaaaggatgcttcaatcggctggttgttgtacgttaagattttgccttgcgtactggctaccgcagctgtgattttcttcagttttgtctcatagcttgttccccactgttttttcagctccgctttgtttttatacacctggaacatctgtgtatcatccaccagtgagcctttaggagcctcaaccgctgaatttgacaccatcagtctgacaataaatgttctggcggcgagagcctgggctttcagtgcttcagattcaaaggttgccggcatttcggaggcgacgactccaatcacatactcttcaagcggaatgtcttctacggattgatttgcggttcgatagacgggaatagaaacaggtgatgctttcaatgtttctgctcctttcgatgctggtttcgtgctgactgctgtcttttctgattctacgctggcccccgcttccttattatgctggaatggtataaccaagaatgtgggaaccaagagaatcaatgcacatagtacggatagtgtgattgcgaattgtttcatattcagctgcctcctgctcgggattcgactctagtctagtctatgggcagggacaagctaatatgactctcgttttggacagaaactttatttgtcatttacgtattcttttttgctattttgcgcataatgatgataatacacaaaaaataaaaaaccagtatgccagagtgacatactgattttcaagtaagtttatgcatttaagtcagaaacgacttctttattctcttgctcagaagcagactcatcatttacacgttcgatgtctgcgcccagagcggcaagcttctgatggaaatcaacgtaaccgcggtctaagtgcttcaattcagtaacacgtgtgtgaccttcagccactaaccccgcaagaatcagcgctgcacctgcacgcaaatcagtcgctgcaacttcagctccctgaagctgtacaggaccgttaatgatgacagaacgtccttcaatcttgatatcaccattcatacggcggaattcttccgcatgcataaaacggttttcaaaaacggtttctgtaatcatgcttgtgccgcttgcacgaagcagaagcgccatcatttgtgactgcatatcagtcgggaagcccgggtgaggcattgttttgatgtcaatcggtttaagttctttcgggccgatgacacgcaggccttcaccttcatccttaattgttacacccatctcttccatttttgcaattaaagaggtgaggtgctcaggaaccgctccttttactaatacgtttccttcagtgattgcagcagcaaccataaatgtgcccgcttcaatacggtcaggaataatatggtgttttacgccgtgaagcttttcgactccttcaattttgatggtgccggtgccagctccgcggatttttccgcccatgccgttgatatagtttgctaaatcaacgatttcgggttcttttgccacgttttccagcgttgttgttccttcagctagagcggctgccataatcaggttctctgtagctcctacacttgggaagtccagataaatttttgcgccttgcagtcggccttttacttcagcttcaatgaagccattaccgactttgatttctgcgcccattgcttcaaaaccttttaaatgctgatcaatcggtctggaaccaattgcgcatccgcccggaagtgcaactcttgcatgacctgtacgcgcaagaagcggccccatgacaagcacagacgcacgcattttacgaacatattcaaaaggtgcttcagtttgcaaagcgtatgaagcatttacagtcacttcattattttcaaaatgcacatctgctcctaaatgacgcaacacttcgttaattgtatatacatcggagagcgtaggtacatcacaaattacgcttttttcttcacttgctaataaagatgcagcgataacaggtaaaacggcatttttagcgccttcaactttgactgtgccgtttaacttctgaccgccgcggacgatgattttttccaaggtattcccctccgcgtccctaaattctctatattaatattcagtcgtaacgattggtgtgccaaccgtaacggtatgttttccgcccattcctgcacttctaagtgcaatttgcaaattcattttatgtttcgaggtcataatgtactcttcccactcatctgtaaacgcagaaatagaaacgaaatttggctcaactacatgttctactgatcttgcttgaaattcatttaataactgatttgcttttttttgcaaaacaatattcatattatcatctaagtgaccatttagacaagtaaaaataactactttttcttggaatatcccaagtgtctcccgttcaaactgttcatatgtatcattccagctatccggtgtctctagactcatttgctcatataataaatacgaagttggattgtgttttttgagggttgtgacaagctgcagtctaaaagaagtacgattttttttgtcagtatatgtgccaattgcctttatcattttatcttcccgtgcaatcacccaatcatattgacgatactctgattttaaacgttgcactttttgataaaattctttttcggtcagtgacatgttttgttttgcatgcaatgtccacttatctattgacacatcttggcgttccatcccctctgccatttttgctaacggcgttaattcactcgcatgaatggtatggaaaacagcaatgacgaagcttaacatgacggaaatgataatagcgtggcttacttgttttttcttcatgttcatctctcccccttatccccagttttaccggaggcaagaggcgccatacgtaaaaatcttcgtcaaaactcgagctattcgcttcaacccgcttctcccaaccatttaatgataataatgttcaaaacctattaaaatagatagggaagctgctgtgaataattgagataatctaaaaagaaattggcaacggccgttccaatggcaattgtcagcaaaatcatcaggagtctagcctgcacgactttgccttttttgattaacggatctatattgacggcttgcaacgcccaccaagtcactgctataaaaatcaggtgaacgacaatgccgattgcagcctgctgtcccaatacactcatctattacactcctttctctgcgttcataccctttcttattatataagaagcacagataaagatgatacattttatacagaacggaataatcagccaaatctagggctaatccccgcttaaagtgcgattcttttacatggtatactttattggaaaggagctggcaaatgtgaatcattctttttttcagcctgaaaagcaatatggtgaggacctgccaatttttgatcaggaatgggaagcaattgcattctattatgattatagacagtcacagattgaagaactgaatgaattgtgtcagttttttaacatttctcttacctatacgagagaaagccttgaagagcttgaaaacctttattttcaaagtatacaagagcttttgcttgctgattggaatcttcctattgaagaattcgagaaaatgatcagtgtttatcttatagattgcgtgattgcccgccatgaagatgctgaatgggttgtaaaaccttatccctataaagacggcgcttatacacttggctttagaagacatcgcaaatcgtggcatacaatgaatgcctgtgatggtttatacctgcgtccaaaagaggatcgcccgctgttatcgctgtttgattctcttgtgcgttcataaaaaaatccttctcataaagagaaggatttttcttatttccctgctacatccaatctgttcaaagcccgctgtaacgcaagctcagcccgacgaatgtcagtatcatctgattgagtattcaaacgctcctgcgcccgctggcgtgcagcttcagcgcgctctttatcgatgccttccgctgtctcggcagcctgggcaaggatggtgacctgatcaggacggacttcgacaaatccgccgctgacggcaaccatttcagtctgcccgtcttttttcagacggacagcgccgattttaagaggagccacggttggaatatggcctggcaaaataccgagatcgccgctttcggctctcacactcaccatttcgatatccgcatcgtatactgggccgtcgggagtaacgatattgactttaacggtcttcatgcttttaccctcctaggaccagattaaacttctacacccatttcttttgctttctcaacaacttcttcgatacggcctacaagacggaatgcatcttctggaagatggtcatatttaccggctaagatttctttgaagccttgtaccgtctcttttacaggcacgtaagaacctttttgtccagtgaactgttcagccacgtggaagttctgagaaaggaagaactggatacgacgagcgcggtgaacgacaagtttgtcttcctcgcctaattcatccataccgagaatcgcaatgatatcttgaagctctttgtaacgctgaagcgttgactgtacttcacgcgcaaccgcatagtgctcttctccgacaatttcaggagcaagggcgcgtgatgtagatgccaacggatcaaccgcagggtaaatacccatttcagttaatttacgctcaaggtttgttgtcgcatccaagtgagcgaacgttgttgccggcgccgggtcagtgtagtcatcggcaggcacgtagatcgcctggatagatgtaactgatccaacattcgtagacgtgatacgctcttggagctgacccatctcagttgcaagcgtcggctgataaccaacggctgaaggcatacggccaagaagggctgaaacctctgaacccgcttgtgtgaaacggaaaatgttatcgataaagaacagtacgtcctgtccttgtacatcacggaagtgctcagccattgtaaggcctgtcaaagcaacacgcatacgtgcgccggcggctcgttcatttgtccgaataccatggctgttttgttgataacgccagagtcactcatttcgtagaaaaggtcgttcccttcacgagtacgctctcctacgccggcgaatacagagataccgccgtgctcttgcgcgatgttgttgattaattcctggattaatacggttttacctacaccggcaccaccgaacaatccgattttaccgcccttaatgtaaggagcaagcaaatcaacaaccttaatacctgtttcaagaatttcaacttctgttgaaagctgatcgaatgaaggcgcctgtctgtgaatcggatcctttttcgcatccgcaggaaccggctcattcaaatcaatattttctccgagaacgttaaatacacgtccaagtgttacatcaccaaccggtactgagattggcgctcctgtatctacagcttccataccgcgctgaacaccatctgtagatgccattgcgattgtacggactgtatcatcacctaaatgaagagcgacctcaagcgttaaatcaatacctacttcgttttcacttgcagctggctgtgaaattttaatcgcattataaatttcaggcaagtgaccgtcttcaaaacgcacgtcgacgaccggtcctaatacctggctaacgcgtcctttcttcatcgctatccctcctgacaaaatctttctattctaaagcggctgctccgccgacaatttccgtaatttcttgtgtgatggctgcttggcgagcgcggttgtaagaaagcgaaagtgaatcgataagttccttcgcgttgtctgtcgcatttttcatcgccgtcattcttgcagcgtgctcacttgctttactgtcaagaagcgcaccgaagattaagctttctgcatattgaggaagcaaaacctccagaacctcctcttcagatggttcaaattcataagacgccgttctttttccgccgccgctgcccaaatcagataacggcagaagttttttctccgttacttcttgagtaatggcgctgacaaaatggttataaacaaggtgcaattcatcaaacgcaccgtctataaacatttggatcgtttgacgggcaagatctttaatttctgtaaacgtcacttcatccccaagtcctgttaactcggaaatgatcggaatctcacgtttcttaaagaaatcacggcccactcttccgatggcaatcaccgcatactcatccttagactgatgacgttcttgcatggcctgataagcattccgtaaaaccgaactgttaaaagcgccggcaagaccgcggtcagacgtaatgacaaggtatgccgtttttttcacttctctgctgagaagcatcgggtgcttcacgttgccggaaactcttccgacgtttgacacaacctcttggattttatccatatatggcacaaatgattttgcattgttttcagcacgattcagcttagccgcagataccatctgcatggcttttgtaatctgacttgtttttttcgttgacgtgatccttgacttaatatcgcgtaatgaggccaaagatttcaccaccttttctcttcatctgcgtaaaaagagagaaaagagaacctttttctctcatcagcattcgagttagttgcttggtgcaaatgtgcgtttgaagccttcgattgcaacattgaagtcttcatcagcaggaaggtttcctgttttcgcaattccgtcaagcaggtctttatggttttggtcaaggtacatgtagtactcttcttcaaaacgtctgatatccgccacaggaatatcatcgagatatccttttgtcagcgcataaagaatggctacttgcttttcaaccggaagcggcttgttcagatcctgcttcagcacttcaactgtacgcgcaccgcggttcagttttgcctgagtcgcttggtcgaggtcagaaccgaattgagcgaatgcttccagctcacggtatgacgcaaggtcaagacgcaaagtacctgatacttttttcatcgctttgatttgcgctgagccgccgacacgggatacagacaatccggcgttgatcgctggacgtacgcctgagaagaacaaatcagattgcaggaagatctgtccgtcggtgatggaaatgacgttcgtcggaatataagcagagatatctccggcttgtgtttctacgaacggcagagctgtaattgatcctgcgcctttcgcgtcgctaagctttgctgcacgctcaagcagacgggaatgaagatagaatacatccccagggaacgcttcacggcccggcggacggcgaagaagcaaggacagctcacggtaagcagccgcttgtttagaaagatcatcgtatacaacaagaacgtgcttgccgctgtacataaattcttctgccattgtaaccccagcatacggtgccaggtacagaagcggtgccggctgtgacgcagacgccgttacaacaattgtataatcaagcgcgccgtgtttacgcaatgtttctactacgccgcggactgttgattctttttgaccgatcgcaacatatacgcagatcatgtcttggtctttttggttcaggatcgcatcgatcgcaacagatgttttacctgtttgacggtcaccgatgatcagctcacgctggccgcggccgattggaatcagtgcatcgatcgctttgataccggtttgaagcggttcatgaacggatttacggtccataacgcctggtgcagggctttcgatcggacgagttttgcttgtcagaatcgggcctagtccgtcaaccggctggcctagcgggtttacaatacggccgattaactcttcaccaacaggaacctccatgatgcggcctgttctttttacttcgtctccctcacggatctcactgaaaggtcctaagatgacgatacctacgtttgattcctcaaggttttgagccatacccaaaacaccgtttgaaaattcgacaagttcaccggccatacagttgtcaaggccgtgcacacgtgcaataccgtcaccgacttggatgactgtacctacgtcttgaacttcaatatcagattgataattttgtatttgctgttttatcagcgtgctaatctcttcagctttgatgctcacttaggtttcaccccttctatcgattttcccggctaattgacgttcaatgcgctgaagcttcccgcttacgctgccgtcataaatccggtttccaatgcggactttaatgccgcctattaaatccgtctgcacttcatttctgattctcagtgaagcgactccggctttttttgcaaacacttgtgataatggtaaaatttcagcatccgtcagcggtttcactgaatatacgattgcgtcttctgtttgacgggcctcatttgcgagtttgataaactcatctgtgagctcaggcacaatcgcggcacgatggcggtcaatcaaaagaaaaatcgtattaagcacggactgtgacaaagagccaaatgcattttggatcagctcttttttcttcgcagccggcaccttcggatggttcaacacatcattaagcgctttttcattttgaaatacttgttttacaacagttagctcttcttctacttgattcagctgagcggactcattggctatatcaaaaagagctgatgcatatcgtttagagacagctgatccactcatcggctttctcctacctctttaagatagtcctggatcaatttctcttgcgcttgttcatccagttctttttcgatcactttcgacgcaatcatgacagaaagagacgctacttgctcacggagagcagaaaccgcctgttctttttccttcacgatttcagttcttgctgcttctttcagacgttcagattctgcacgtgcagcctgaataatctcttctttttgcttctctcccagtttctttgcgttttcgataagagtttgggattcctgtcttgcttcttttaaaagaacgcgctgctcttcaatcagctgctgcgcttctttatttttttcttcagcagacgtaatttctccagcgatgtggtcttcacgctgtttcattatgtttaatagcggccctaaagcgtatttcttcagaagcgctaataagattaacatagctaacagttggaacaggatatctccgccgttaaacgacaatcctagttcaagtggtaattgagacatctactacggcaactcccttctgcaggtttttctttgctgatccagcagccgcacttgtctcttttcagccggcaaggcgggatgcttatcagacataaagcaatggcgaaggttctcttggaatgatcttcgccatttttagttcatataaggcttttatgcttagccaaagaacgctaagaatgcgataacgacagcgataataggaagggcttcaactaatgcgatacccatgaacataagagttctcagttctttacctgcttccggctgacgggcaatcccctctaccgtacgtgaaacaatcaaaccgttaccaatacctgcaccaagtgcgcctaaaccaattgcaatcgcagctgctattaaattcatgaaaaagttcctcctttaaaatgttatccgtttggatataatgttttaatgatcatgactgattttatgagacatgtacaccatcgtcagcattgtaaagataaatgcctggatagcaccaataaataaactgaatgcttgccatgccagcatcggcagaatggcaccgattgtaccgacaagaccgagagccacgctttgcgaataatggcttgttgctaatcccgcaagcaggccgagaagaatctcaccggcgaagatgttaccatacagccgcaaacctagagtcagcgtattcgcaaactcttcgatgattttcatcgggagcatgaatggaacaggtcttaaatagtctttggaatattccttgagccctttcatcttcacaccatagtagtgggttaaagcaacaaccatcacggctagcgttaatgtaatggcaggatcggctgtcggagacttccaccagagctcatgtccgattgtaatagagaacggcagccccagcatattcgacacaaatatgtacatcagcaatgtgacaccaagtgccaagaagttagcccctgtttttaaatccattgtactgccaataatattgcggacgaaatcaacaatccattccataaagttctgggcttttccgggacggatcgaaagcgttcttgtcgtcaatatagcaatcaataaaacaatcacactcgccacagtaatcatcagaatgtttgtcagattaaaagtaagacctagaaattctatagttctgtaaccatgattcaaagggttttcacctctcttccattgatgaacgtttaagctggataaaggaatctatcataatgacagggtatattgtcattaatccaataactgtacttgccatatgaaagtatgcgggatttttataggcaacagccacagcaagaatcgcattgcaccaccgcgctgcgctcccgagagatcgtatggactttcctttctcaacagctctgtcaaaagcattcattcttctgacgagcagtaaaaaattaaacaaactgaaaacagttcccagaataaggcctaaaaaaacggttttatacgctgttaaaccataacccagtacatacactgccaaaatgaacaataaatatttgcgttgtctgctaaatgtaagcttgggatcgtccatcaattatctgtctcctgatgaaaaaataatgtatagcttggatacggcaaaaatcagcggttaacccttagtagaagaccttttttgaccggcaaaacgggcctgttcgaaaaaatcattcatccgcaagccttgcagggatgctgtttcattcgcttaaataaatcctcataatacgggtttgctgagaggatttacattgaggatgaggactataatgaaagctatgaaaaccttctcataataccctcgtttagcatacaatagcccctaacatgtgtcaatctgtttaaagttaaaaaactttttatactttacgtctccacagaatgttcacattttcacctataattgtatacagattcaccgaatagcaaaaaactggataaaaaaatgaaacccccttttggggatttcattttttattttgttccaaacatgcggtcacccgcatctccgagacctggaacaatatatcctttttcatttaatttttcatctagcgccgcaatgtaaatatcaacgtccgaatgatgcttctgcaattcttccacaccctccggcgctgctacaagacacatgaaacggatatttttcgcaccgcgttttttaaggctgtgaatggcttcaactgcggaaccgcccgtagcgagcatcgggtcaactacgatgaattcacgctcttccacatcagaaggaagcttgacatagtattccacgggttttaaggtttctggatcacggtaaaggccgacatgtcccacttttgccgcaggaatcagctttaaaatgccgtcaaccattcccaatcctgctctgaggataggaaccactccgagttttttccctgagatgactttcgatttcgcagcctgaaccggtgtattgatatccacttcttccagaggaagatcgcgggtaatttcaaatgccatgagtgtagccacttcatctactaactctctaaaatccttcgtacctgtattttcattccgtatatatgtcagcttgtgctgaattaaaggatgatcaaatacataaacctttcccatactgtgtttcagctccttttttattgtcccatcaacaattacacacttctattgattctacaaaaaaagacattgagtttcaagaacatcgtcaaaaaacccgccgggcataagccccagcgggttttaggatcttaataatctaattctttatataaaggaaatttatcagtcagagcagctacacgctgtcttgcttcttcaagttttccttcatcttcgtggtttttcaatgcaagcgcaatgatagcaccgacttcttctaatgcgtctccgtcaaaaccgcggctggttacagcagctgtaccaagacggatgccgcttgttacgaaaggtttttcaggatcatatggaatcgcgtttttgttagacgtaataccgatttcatcaagtacatgctccgcaaccttaccagtcagtccgagcgaacgaaggtcaacaaggataaggtggttgtctgttccgcctgaaacgagctggatgccctctttcgttaaggcttcagccagacgtttcgcgtttgaaatgacgttttctgcatatgttttgaaatcgtcctgcaatacttcaccgaatgaaacagcttttgcggcaataacgtgcatcagcgggccgccttgaattccagggaagatcgatttatcaattttcttgccaaactcttcacggcaaaggatcataccgcctcgaggaccgcgaagtgttttatgtgttgttgttgtaacgaaatcagcgtaaggaaccgggtttggatgaaggcctgccgcaacaagtcctgcgatatgtgccatatccaccatgaagtaagcgccgacttcatcagcaatttcacggaatttcttaaagtcgattgtacgaggatacgcacttgctcctgctacgataagcttcggtttatgagcgagggctttttcacgcacgtcatcgtaatcaatatattgagtttctttatctacgccgtactcaacaaagttatattgaacaccgctgaagttgactgggcttccgtgtgttaaatggccgccgtgggagaggttcatcccaagtacagtatcgccttgctccaaaatcgtgaagtacactgccatgtttgcttgcgcgcctgaatgaggctgaacgtttacatgctccgctccaaagatttccttcgcgcggtcacgggcgatatcttcaacgacatcgacgtgctcgcatccgccgtagtagcgtttgcccggatatccttctgcgtacttatttgtcaaaacagatccttgtgcttccataaccgcttcacttacaaagttctcagaagcaatcaattcgatcttagtctgttggcgttcacgctcatttttaatggcgttaaacacttgttcgtcttgcgcaggtaaatgtttcatcagcgagatcctctcctatccgtatcctattctttgtttttaccatcactattgtacatggtttttaaggccgatgtaaaagattatttttaaaaaatctaaatttttattggtaaaaacgaatattaataacttaaatttaatttaaagttcggaatttatttcactgtcttaaaataaaagaaaagactggctatgcagtcctttcattcgcactcataaaccgcccgcactccgccgattagtttcggccgtgtacgcgccaatgtcacatgagctgaaccgaggctgttttgagagacacgcacagggacagccaccggcttcagatgcatgccgataaacgtatcgcctatatcaattccggcgtcagcctgaatggtttcaacaagaacaggagacttcatctgcttaaacgcataagacgccatcgctccgcccgcttttggaacgggcacggcagaaacggttggaagcctgaacagcttggccgtttctgcttcgacgacaagcgctctgtttaaatgctcgcagcattgaaacgccagatggattcccgttttttcccgaagctcagcaagtccgctgtagatgctttcagcgatatctacactgcccgatgtgccgatccggctgccggccacttcgctcgtgctgcatccaaggacgaagagctgatcttgtttcaattccgcttggtcctgaaactcagacagcatcgtcttccacgtttgtttcaactcattcattaaacagcacccctacaggtttttctcttcataatctgagatttttccaatacgcgtttggtgtcttccccggtaaactcagtagtcagccagatttttgcgatttcccgagccaaaccaggtccgatcacccgttcacccatcgcaaggatgtttgtgtcattatgctccctcgtcgccttcgcgctgaaggtatcgtgcgccagcgcgcagcgaatcccttttactttattagcggaaatgctcatgccgatgcctgtcccgcaaattaaaatgcctctgtcaacttcgccgctaaccactttttcggccaccggaaaagcataatccggataatcgacagagccgctgccgcagtcacagcccatatcaatatattcaatttgcaattcgtccattaactctttgatttcatttcgaatgtgaacgccgccatgatccgatgcaatggctactttcatctgcttttcctcccagcgtgtgtgatgcggcccgcccgctttattgaccgcgcagcctgtccgctctttgattcacaccatatgatgtgcttttcactatattctactccttcacgcaggatttgcaaatgacctgtttacagattttctgacaacttatctgcggtcttttttcagctgttttgccagctgccgaagaagctcttcaagctcatctcgcgtttgtttatagatgtcaattgagccgccgaacggatcgatgacatcaccatggctgcctgtgacatattcttttaacgtaaacactttatcacgataacgtccaaattggctggcaatgatctgcttgtgctgatgggtcatagccagaaccaaatcagccgactccatatgttcttcagttaatggagaagacacatgattaagggcaatgtgtttttcaaacagcgcttcgactgcatgaggcgtcgctttcccattaggtgaagcaaacacgcctgccgagcggacattgacattcagcccttccatttctgcaattgatttaaaaagcgcctcagccattgggctgcggcacgtatttccagtacagacaaaaataatatccatgtcagtcaccccttatttttctctattatatatgaagaaaaaagaaacggcgacttcgtttcttttattggtatattaaattggcaaaagcagctttagtccaaacacgattaatatgatgcccccgagcgcttcgctgtatgtgccaagccaagactgcacttgttttccgaccagcaggcccagccatgtcaacatcatgctgaacagcccgaacagggtaattgtgaggagcggatgcgagccgtatatccccaagctcaagccgacggaaaagctgtcaaggctgacgccgatggcaaacagcaataagcccggccctgccggtgacatgaatcgttcttctgactgtttaaaagaggccataagcatttgaaccccaagaacaaaaagcagcgccccaccgatataaaccgctaacacgccgaggagccctgacagcatgttaccggccgccatccctgcgagaggcatgatgacgtgaaagaggccgatgatgaaaccaatatagaatatctgcttctttctaagtttgaccatgcccattccaaggccgacagaaaaagcatccatccctaaagcaaacgccatgatgcttaatgtaatcagttcgcctataaacaaatccgacatacataaataaccccctggacacgccccgcttttttagcctatgcgtgtccaaaaagggttagaacatctgactgctttcagcgaatcactcttcctccggcagctttcatcagcctgttcataatagcaagaccgacacctgtatccggaaaggattccgctataatgaaatccaccttattctcatcaaagctgcgcaaagcatcatacagccctgccgcaacagtctcaagctgagcccgtcttccgcagctcttcacataatcagcggaataaacgcccgcgttttcttctgtcgtcaggacaccaacccgtcttccgccctgttgatattcttgaatgaggtgctgaatgcgctctgggctgccttcgcaaatggcaagaggcgctgtcggcgcataatgtgtatatttcatccctggagaaatcggcttctcgttttggtcgctgagccctttatccacatggatcggcccgatcaccgcttcaatttgttccttcgtaatgccgccaggacgcaagagaacagggatgtcgtccgcacatgaaagcacggttgattcgaccccgattccggtagggcctccatccataataccggctatgcggccatccaagtcgtgagccacatgctctgcttttgtgggacttggcttgcctgatagattggcgctcggtgctgcaatcggcagtcccgattcgcgaatcaatgcaagggcaagcggatgatccggcattctaatggcaaccgtttcaagacctgccgttacacgaggtgaaagcgcatcaggtttgcaaggcagaatgagcgtaagtgctcccggccaaaaccgtttcatcaatgttttcgccttttccggcgctgggcccgttaaatcctcaagctgactgatatccgcaatgtggacaatcaggggattatcgctcggccgccctttcgcctcatatatttttttgacggcatccgtattttttgcgtttgcgcctaggccatatactgtttctgtcggaaaggcaacgacctcattttctcggagcaaagcggctgcttgtgcaatttgtggatcatttgtggataactcgtcagttacatccacaaaccatcttttcgttttcatttctgaccaaactccttattcacaacaataaaacgattgttttacgcgtgtaatccttttgaaagtataaaagatgtcctgtaataaaacaagcgttatccacaaattgtggacaacgctaataaagaagtggataagtatgtgtataaactgcacttatccagacgcttttttcattaaaacggctccttctgtttgccgcgattcacagaagtgatcagaagaaaacagctcctccggtacactctcagctctttcaaaacccatagccgtcagaaagtccgcagaggaatgctgatttgctactaggtacacggttttgatctgatgcttttcgcacagcacctccatgctttgaaaaagcgtgacaatgtggccttggtgaagcttgtccgatatgacaagtgatcgcagcagcccctggtcacagcttattttttcaataccgaggcatccggcaatgtttttctcactgtcctccagcataagaaattgagtgaagccttctttcacgccttcatagctggtttttgcctgttttaaaaatgcctcgagcacatctccgtctttttcccttgccacccgcagttgataaaacatccgttcaccccgtttttgcgttctttcttccaatctatgaggcaaatctatttttagaccagatgattaggaaaaaaggtcggaaatccattcgactaaaaagaatttcacttctgtgccgtcttctttttcttcgttctcttcttttttggctttttccgctttagcggttacgtcctcaagcactttttcagtctgcttttttgaggcttctttatcttcttgttctttgacggcttccccgttagaaaaatcgagaaagcagaggggcgggaacagcacacaccaccagttggcgccgtctccgtttccaagcgtaatcaaaatcgcttcatactcaccggcaggatataccatgttgccgtaaagctttgtcggaaacgagattttgtcaaaatcaacggatatcgactgattcgctccttctttctccattgtttcctttgcaattgctttgatttcaggcagctttgaacgaatcacgcgacgcgcttcttcaatagaagtaatatcctttacccaagttgtgatttctttattcaccgcgtctcttatatgacgttttaattgctgatcttggtcactatcgctgtttgccaatattctcagacgaatcgcctgatccggtatgaccaccggctgattttccgatttctgtgccgtctcttcttttgccagccctacgagcgctccagatagtaaaagaaagatatatatacaaatgattactgtttttttcatcggtccccaccgttcctctccgtgctttgtttctagccctattatggacaagtagagccaggggtaaacgtgcagggtgaaaaaaatctagcaagctgttaatcttatttatggtacgatagtgttttaggaggtttaagatgaaatacaattatacagtgctgttatcagcattcacgatgtccgttctttattcagtaatttatattcattcatttatcattgccgctctcatcacaatggcattttattttctgtttccttatttgatcttcgcactgccgcttcaaatcaagatgaataaaaagccgaaacggttcagccctttgtatctgctgtattaccttgtcgctgcttttattgccaacgcgatcattttcggcgtgcttcagccttcgggacaatctttgtttcaaaatacagccttctatcttttcgctgtattaacagctcttatctattggatatgggactctgttttactgcaaaaaaaggaagcctaagaggcttccttttttattaaaacaaaatcgtcagcaaataacatagaatggaaggtatcgccgcaacaaagaaagcggccgccattttcatgcgagatgtacggccttctttggtttctgaatggtagtttgcccgctgatcgcttccgcttacagccaaacccgatgtaatgatcgcgagccccactaaaacgagagacgcaacgccaaaaatcgcttcatatgaaagagcctgcggaaaaatggtgccaatcatgctctcaatcgcaatgagcaggattcctgctgtcagggcctttttcatgtttacatcccctttgctggtgttaaacagcttgatccattcactcgccagcaagctgcttatttatttttatgaatcagagcgcatatggttctgtcttttccattaatatctttcagcacttccacttccgctcccttaaacgccttgaggatcaggtctttgaccgccgctccctgtttccacccgatttcaaaaacaacaaatactttatccttcatgacaagcggaatgtcttccataaaccgcttataaaatttcagcccgtctccgccatcggtgagcgcgtgcagcggctcatgaaaacggacaatttccgatagatcagccatttcttcctctgatatatatggcgggtttgagacaatgatatccgctttttttcccgccttaataaaaggctcaagcagatcgccctgataaaagcgcacatttgctccgagtttttctgcattggcagaagcgacttgcagcgcctctttcgaaatatcgaccgccgacacagaaaagttttggttttcaagcgcaagcgtgacggctattgcgccgctccctgtaccaacgtcaacaacttcgagcttgccgtcttcagaaaagacactccgatatttttcaagcaaatgaaagacaacttcttcagtttccggccgcgggatcagcacatcatcattcaccataaattcccgtccataaaaaaactcttttcctataatgtattgaaccggcacgccctctttatgcatctcaacgtgacgcttaaagcgatacagctcgtcttcaccaatcggttcctgtaagcttgcgagcagtttgcttctctccattccggtatcataaagcaataggagctcggccgcattttcttctcttcccgcttcggttaaataagaagaagcccatttcagggcttcgaatatcgtcttcatcttaaccttccgactgctgaagcttgcttgcctgatcttcaacaatcagcgcttcaaccacttcgtcaagttttccttcaagaatctgatcaagcttttgaatcgtcaaaccgattctgtgatccgtcacacggttttgcgggaagttgtatgtgcggatacgttcagagcggtcaccagatccgactgctgatttccgtgtttgatcatattcagcctgggcttcctgctgaaatttatcatagattctggcacggagaaccttcattgctttttctttgttcttaatttgagatttttcatcctggcatgatacaactacacctgtcggcaagtgagtcagacgaaccgcagacattgttgtattaacgctttgtccgcccggtccgcttgaagcaaacgtatcgacacggatatccttctcatggatgtcaacctctacctcttctgcctcaggaagacatgctactgttgcagtggatgtatggatgcgtccgcctgattctgtttccggaacacgctgtacgcggtgggcgccgttttcatatttgagtttagaatacgcgccgcttcccgtaatcataaagatgatctctttgtagccgcctgttccggttacattcgcttccatgacctctgttttccagccctgaagctcggcataacgggaatacattctgtacagattgcccgcgaataaagcggcttcctcgcctcccgcggctccgcggatctccataataacgtttttatcatcattaggatctttcgggatcaagagcactttcagccgttctgacagtgtttccgtttccttctgaagttcagaaatctcttccttcaccatgtcgcgcatctcagcgtccagcttctcttcaagcatcgcttttgcatcagccagctgttctgacgcatctctgtattgtctatatacgtcaactgtttcttgtatatcagattgctcttttgaatattctctcagctttttcggatcgttgactacttctggatcgctcaaaagctcatttaatttctcgtatcgttcttcaattgattttaaacggtctaacacggtcttcacctctgttttcctgtgcgtaacattctcattatagtatagtgattaaccccagtcaaaagcatttcaatcccagctggaaaagccccctctgctatactggaattctaggagggatgatgttgctgaaatccatacatcatattgcaatcatatgttcagattacgaaaagtcgaaagctttctacgtacataagcttggttttcaggtgattcaagaaacgtaccgcgaagagcgcggctcctataagcttgatttgtcgcttaacggctcgtatgtcattgagctgttctcgtttcccgatccgcccgaacgacaaacccggcctgaagccgcaggcctgcgccacctcgcctttacagtcggcagcttggataaagcggttcaggagcttcatgaaaaaggaatcgaaacagagccaatcagaacagatccgctgaccggcaagcgtttcaccttcttttttgatcctgaccaacttccattagaactgtatgaacaataacagtttttgaagaaaaaaaggagatacccactttctttgccgaatcttttcctgttttgtctaacgggaagggaaccgcattctatggtcgaatacctagcttaaaaggaggtatgggatcatgaatacaaatatggtagcaagtgaactcggcgtctccgcaaaaacggtgcagcggtgggtgaagcagctgaatcttccggccgaacgcaatgagctcggacactattcgttcacggcagaagacgtgaaggttctaaaatccgttcaaaaacaaatctctgaaggcacggcgattcaggatattcatctgccgaaaagcgctaaaaagcgcacaggcttccttgtccaaaaaacaaatagcgacacagaacgaagaatcgagcagcttgaacaaaagctggacacccttttacagcaaaggcaggacgaaaatgaattgatggcaaggatgtcggaactggaacgccagctgaaacaaaaagccgatgaaggtgtatcttaccagctgcttcagcaccgcagagaaatcgatgatattcttgcagatctgcaatcactgacctcacaaatgaaagaattcaccgctcagccgatccccgagaccgctgctgcttctgaaaaaaacaaaacaagaaaaaaaccgctgctgtcactgttcaaatttcaaacctaaagcaaaaagctcccgtaaagggagctttttttgttacgcagtaagcgcgataatgattggaagtgaaatcaatgacagaatcgcactgaccacaaacgcagttgcagtttcttcttcttgtttctcgaaacgagtcgcaatcatggctgcaacggcagaaccagggaatgcaacaagaagaattgcttttgttgtttggtcagccggaagtccgatagcaagagcaatcaagaacattaacgcaggctgaaccgcaacttttagtaacgcaataccgatagccggcatactgagtttaattttacgaataccaacggtaacaccgacagcaaagagagcaacaccagatgttgtgcttccaagctgatcaagcattttaacacccagctcaggaagagtgaaattgaaaaccagcactaaaatcatactgattaacggagcagctgcaagcggctcacaaagaccatgcaggattgattttcctgtcatcttccagaagctgtcgccactctcttcgtttttcttagaagactcaccaacagtagcgataatgatcgcgagcggatcaagaatcgcgttaaccacgatacctgtgaccgcgatcggaatcgcaacttcattcgctccgaataagcttcccaataccgggatacccataaatgcgaatgtcggctgtgcagagttcaaagaaaatacagatgagttcgttaaatcatacttgaaaataaatctgcaaaccaaaagaatgatgatatagaaaccaacaatcccaataattaaagaaatcattaaaggtacttgtgataaaaattcacttctggaagttgtcaaaataccagcgataaagtgagctggaagtgcgtatttcgttactaacgtacttaccccttttgccgacttggcatcataacttccaaaatgtcctgcaaaccaacccagcacgataacaaagaagatcggcgccaggaggattaagatatctaagatgctcaaaatattctcctccaaatcctatgtccgtatactttagctttacaaaaagctttccctcggacagaaaaatttactcgctaattatttcgcgatgacttttttgtattcaggtgtccacattgcatcaagtaccgcttgtttcacatcttcaggctgacgatttgccacgccgtctttaattgctgcttcagcaacggcaatcgcaacttggatagaaacctcttgaagcttatcaatgcttggaagcaatcctgctccaggtgtttcaagatcaaccatttcagcaatcgcatcagcagttgcagcaaacatagcaggtgtaatgatacgcgcttcagctacaattgaaccaagtccaagaccagggaacgcgaatgcgttgttagattgtccgatttcataagaaacaccgttgtattctacattgtcaaatgggcttcctgttgcaataagcacttttccgtcagtccatttgaacagatcttcaggaacagcttcagcaaggtgagtcgggttagacatcggcatgataaccggacggtctacgtgagatgccatttcttttacaatttcctctgtgaatgcacctgaaacccctgaagtaccaatcaagattgttggtttcgcttgacgaaccacttcatcgaatggaatttgacctttttcatcgcgcttccagtctttcacttcatccgcattgcgaaggtaaggtttttggaaatcaaggatgccttcgatgtcttcagtcagcaagcctctgtaatcaagtgtgtagaaacgtttgttagcttcttcttcagataatccggctagcaccattgtgtcacggatttggtcagcaataccgataccagcagaaccagcaccgaagataacaacacgctgatctttaatagaagcgccggttttcttcatagcagcaagcacacctgcaagtgtaatcgcgccagtaccttgaatatcatcattaaatgtcaggatttcatgattgtattttttcatgatgttgcgtgcatttttgttgccaaggtcttcccagtgaagaagcgctttggggaagaatttcaatgcagcttttacataagcgtcaatgaaagcttcgtagcgttcaccttgaacacgttcatgcttgttaccaatatataaaggatcgtttagaagtttttcgttgttcgtaccgacatcaagcacaaccgggataacacggctagggtcaataccagctgcagcagtgtaaacagccaatttaccgattgcgatattaataccgcctacaccccagtcaccgataccgagaatgctttcggagtcagtagcaacgataagatcaatatcgcctgctgtcgcatgaaggttttcaaacgctttttcaataccgtcaatattatcgattgacaagtagattccttgaggtcttctatattcatggctgtattcctgaatcgcttcaccaactgttggcgtgtacacaacaggaagcatttcgcgaagatggtttttcagcaatttatagaaaagaacttcgttacggtttgcaagatcacttaagtaaacattttgacgaaggcggtcaggctgcgcttggaattgctcgtacgcgcgttgtgcttgttgatcaagagaaagtacagttggcggcagaagcccttctaagccgagttcttgtctttcttctagtgaaaaagcaacgcctttatttaaagtaggaatagataaaacttcttttcctctaagagttgtttctaagtggccttctttcgttttttttatgttattcaagcaaatctccttctttcttgaaatagttaaccaagttaagtaataacccatctaaaatatgaccgatcatgatctttatgcgactttgtgacaattattcgaacaatgtctcaaaactatttacattacgtaagctattgtatgcctgtcaaaatcaaaattcaagagaagaaaattacttaatttttaatatacttatttaaattttttaattgaatattatcagaatataaaaaaaacaccggtgtttttagccggtgcattctatctttatacccatgttttggactattttttagatttacctgggacttcgtgatgatgtctgcatcttgcttcatatgattcagatgcaccaaccaaaatgaccggatcatcgtaagaagcaggtttgccgtcaatgaggcgctgtgttctgctcgccggtgatccgcaaacagaacagacggcttgcagctttgtcacactttccgcaatcgccatgatattcgggacgacaccgaacggctctcccctaaaatccatatcaaggcctgctgctatcacacggtagcctttatcggcaagagatgataaaacctcaacaatttcctgatcaaaaaactgcacttcatcaaccgcaatcacatctgtactttcactgatgtgatcccaaatgtccgcagcagacgaaatggcatagctcgtcatcgatgttccattatgggagacaacagcagcttcgctgtatcggttatcaattacaggcttaaataccctgacttcctgcttggcataagttgctctcttcactcttctgatcagctcttcagatttccccgagaacatgctgccgcaaatcagctcaagccacccgctttgtttcattatgtacataggcttcgctcccctctctctgccagctgtgttttagacaatataaaaaacaggcaagactgctgcttgcctgttgagaaatctattattacttaagaccgtattttttgttaaagcgatcaacacgaccatcagcagaagcgaatttttgacggccagtgtagaatgggtggcattcagagcaaatctcaacgcgtacctcttcttttactgagcctgtttcaaattcatttccgcaagcgcatttaactgttgcttttttgaaattaggatgaattcctgctttcattgtatccatctccttccgccctgaatcccgtgtggaaacagagttattatttcggagcattgtccgaaacgcatatgagaaaattatatcagtgatttacttcttttgcaaatacaatttaccttcttgcagatgatagatttgcctgtttccattcttgattgagaatatcgaaaaattcctggtttgttttggtttttttcatttttctcatgaacttttctgcgaaatcaggtgaatcagacatcgttttgcggatagaccataaacgatcaagatgctctttaggcacaagcagctcttctttgcgcgttcctgaacggcggatatcgatggcagggaagatgcggcgctcggcaagagagcggtcaagatggagctccatgttgcctgttcccttgaattcttcataaatgacatcatccatacgtgatcctgtatcgaccagagccgtagcaagaatggttaagctgccgccctcttcgatatttctcgcagctccgaagaagcgtttcggacggtggaacgccgctgggtcaatccccccgaaagcgttcttccgctcggcggaatcactaagttgtaggcacgggcaagccgtgtgatgctgtccatcaggataatgacgtcttttttgtgttccacgagacgcatcgcacgttcaagcacaagctcggccactttgatatggttttccggcacttcatcaaacgttgagctgacgacatccccagctacagagcgctcgatatcggttacttcctcaggtctctcgtcaattaaaagcacgatcagctctgcttcaggctggttcgctgtaatgctgttggcaatttccttcagcagcatcgtttttccggctttcggcggcgcaacaatcaatccgcgctgtccaaatccaaccggcgccatcatgtccataattcttgtagacaagaagttcggctttgtttcaagcaccatttgacgatccggataaagtggcgtaagagccgggaaatgcacacgctcttttgcagattcgggatcatccccatttactgcttcaacgtgcaaaagtccatagtagcgctcattttcttttggcgggcgaaccttgcctgatactttgtctccgttccgcaaatcgaaacggcggatttgtgaagctgagatgtaaatgtcttctgagcttggagagtagttgatcggtctcaggaagccgaaaccttcagactggatgatctcaagaacgccttccataaacagcagatcttcttgttctgcattcgctttcagaatggcgaaaatgagttctttttttgtcagtttgctgtaataggagattttataatgtcttgcaagttcataaagctctttcaatttcatattttccaaagaggaaatagatacgtctttcataaaaacaccacgcttttcatagtcaatatcttactctgaacatgtcatctgctgcttttgcacaacatccgccaaagcacattctttttttaacataaaggaacttctatcggtaacacttccacccatgatcggcgcttttgttaaaaggattgtcttaatgagttttgaaggaagcgaggacaaaaacatgagaagatcaatacttatatcgtctgtatgcggtagaaattgaaactttcctagtgcttaaaagaaggtattacgcagtaaaattcgcagcactctttatttttaccttatttcaaaaaattattcaactgaaataaggttttgacacggaattgatagagttgacgcttttctgcaaaagttaaagcgggctcacacccgctttttctgtttgttatggacggattacaagatttggtttctttttcaagctgtgtctgccgtcaacgaaacgaacagtgcctgattttgcacggataactaagctttcagttgtaccgacagagcctttgaattgaactccttttaacagctcgccgtcagtaacccctgtagctgcaaaaatcgcgtcatcacccttcacaaggtcttccatgcgaaggactttgcttaaatcaaggcccattttgtgacagcgagtgatttcttcttcgctttgcggaagaagtttaccaatgatttctccgccgagtgcttttagcgcaacagcggaaagcacaccctcgggagcgccgcctgatccgaacaggatatcaacgcccgtgtggtcgaaagccgtgttgatggcgcctgcgacatcgccgtcattgatcaatttgattctggcgccggcctcacgaagctcggaaatgattttttcgtgtctttcacggtttaaaattgtggcaacgacgtcctcaacgtccttgtttttcgcttttgccaccgctttaaggttgtcaatgacaggtgcttcgatgtcaatgcagcccaccgcttccggaccgactgcaattttttgcatatacatgtcaggagcattcagaagcgtgccatggtctgcgaccgcgatcaccgtcagcgcgttccagccgccgcttgctaagatgtttgtgccttcaagagggtcaactgcgacatcaacgcgagggccgtacccgtttccgagtttttccccgatatacagcatcggcgcttcgtccatttccccttcaccgattacaacggtccctttcatcggcactgtatcaaaaacgtctctcattgcacttgttgctgcttcatcagcctcatctttttttccccggcccatccatcttgctgatgccaatgccgcagcctcggttacacgtaccaattccattgataaacttctttccatttcaacacgatctcctctcacaagaaaccattatgaattttgaagctgttctatttcttcgtcagtcattctttcacgccaaattgtcgctccaagcccctcaagcttcttctcaaggctgctgtatccgcggtcaatatgctccagtcccgtaatttccgtgacgccatcagccattagtccggctaccaccaagcaggctccggcacgcagatcactcgccttcacttttgcgccttgaagctcgacaggacctgtgatgatggcagatctgccttctactttcatattggcacccattcgtctcagctcatcaatgtgcttgaatcttgccgaatagatggtgtctgtgacgacactcgtccctttcgcccttgtcaggagcgccgtcatcggctgctgtaaatcagtcggaaaccccgggtatacgagggttttgacgtcaaccggctttaagttcttctgcccgccgacaatgaggagctggtcgtcgcttgtttcgatatgatagcccatttctctcagctttgccgttaacgactcaagatgagtggggatgacgttatcgataatgacttccttgcccattgcagcccctgcaatcataaatgtcccggcttcaattctgtccggaatgatcgtatgcttgcagccgtgcagttccttcacgccgtcgattcgaatcacattggtacccgcacctttgattttggcgcccatgctggtaagcaatgtcgcgacgtcaatgatctcaggctccttggcagcgttttcgatgatcgttttcccttctgccaaaacagcggcgagcataatgttaatcgttgccccaacgcttacgacatctaaataaatccttgcgcctctcagcctttcagctcgcaaataaatggcgccttgttcattggttacttcagctccgagtgcttcaaagcctttgatatgctgatcaatcggacggggccctaagtgacagccgccaggcaatccaatgaccgcctgcttgaagcggccgagcatcgcccccattaaataatatgacgcgcgaagcttttttactttcccgttaggaagcggcatgctgatcatcgacgtagggtcaacaaccatttccccattctcaaaatgcacgttgccgccgatttcctttaacaggtcacgcagcgtttcaatatctgaaatctctggaagcccttcaattgtcacctcggaatttgccaaaatggttgcgggtattaacgcaacagcgctgtttttagcgccgctgatatgtactgtaccgtttaacgagtcaccgccggcaatattcaacttttccatgatagtctccttccataagaagatagctgcggagctaaataaaatgtcattttattctgtctctgcaaataaagctcatgtccaaaatctagccaattcgaagagaaagaatacaacacattgtaaaatatcaggaagaaaatagcgaagctttgggggggtacaggtttcaaaagatgcacagagacccgccggctcgagagacatcgtcgtcatccggcaaaagcagtacgcatacccttcattccaatatcagcttctgcagcccaatgattccttctctgtaaagcggcgtcagcatctgaagatccgctgtatcaggtcggtgaaatacaaaggccgcggcaaacaggcataaagctgtttgccgcccctttcattatttgttccagtctgccaggaattgttcgattcctttgtctgttaacgggtgtttagtgagcgcatgaatgactttcagcggcattgtgccgatatgagcccctctaagagcagcttccgtcacgtgctgcggatggcggattgacgctgcaatgatttgcgtgtcaaggccgtgaatgtcaaaaatctgtttaacttctgaaatcaggtcaagcccgttgtggccgatgtcatctaaacgtcccaggaatggagatacatatgttgcccccgctctggcagcaagaagcgcctggttggcattgaagatcaatgtaacgtttgttttgatgcctaagtcagtaagtgctcttaccgcttttaaaccgtcagacgtcattgggattttcaccgtaatgttcggagcgatcttcgccagttcttttccttcctcgatcatttcctcagctttcaaagaaataacctctgcgcttacagaccctttcacgacgtctgtgatctcgcgaagacggtcgtggaatgatacgttagcttcctttgctactaaactaggattcgtcgttacaccggcgagaattcctaattcattcgcttctctaatttcatcgatattggctgtatcaacaaagaataacattttcaaaaagcctccctgattaagaaattttctgaactgcgaatatgattgcgctttctaaagatagacggaaaaccgcctgtcaagctgtcaggcggctataaaaagttccaattgaattaagcttggtttgaagaaccaaattcacgcattttaccgataactgtttctttgatcgcttcacgagctggtccaaggtatttacgtggatcgtactcgtcaggcttagctgccaatgtttcgcgaacagcttttgcagaagaaatttggttttcagtattcacgttgattttagctgtaccaagtgaaattgattttttgatgtcagcagtcggaattccagtaccgccgtgaagaactagcggaagaccagttgattttccgatctcttccatttctttgaagccaaggtttggctcacctttgtaagggccgtgaacagaacctaatgcaggtgcaaggcagtcgatgccagtgcgctcaacaagctcttggcactctttaggatcagcgtagattacgccttcagcgataacgtcatcttcttgtccgcctactgttccaagctcagcttctacagatactccgtggaaatgagcaagctcaacaactttagcagttgttgctacgttttcttcaaatggatggtgagaagcgtcgatcattacagatgtgaaacctgcatgaatcgctttcgcacaagattcaaagcttgaaccatggtctaagtgaatcgcaacaggaactgtcactttgtactcttccataagtgcttttaccatagcaacgactgttttgaagccgcccatgtagcgtcccgcaccttcggaaacaccaaggatcactggagatttttcttcttcagctgcttgtaaaatcgcttgagtaaactcaaggttgtttaagttaaattgtcctacagcgtaccctttttctttagctgtattcaacatttccgtcatagaaactaaaggcatgtcgaatgtcctccttatgtagcctgattgtcttctagcgaaaaaagctttccaccctagcatgacccatatattgctgtcatatgtaaatactcagatcgctttttctccataactaggataccaacttttcgacaaatcggcaacataatgacatgattcatttgtttcttctttttgtcagttagacttcaggggcagatattttttgacggcgtctctgatttcgtcgatgtcaaacggcttggcaaagtgcgtcagagcgcccaattccttcgattcctggatcatgtcgagctctccgtatgccgtcatgataatgacccggatgttttcgtcaatgaccttcatccgttttaagatttcgattccgtccatgccgggaattttcatgtccaaaagcacaaggtcgggccgttcttttgtcacaatgtcaagcgcctgcaggccgttcgcagcctgaaacgtctggtagccttctttattgaacacttcatttagcaaaatacgaatgccgtattgatcatcaacgattaaaattttttcattcatcattttacaccccaatattatgattttcgtcaaaagtaagcagtattgtatgtattctgtttgattttcctatttcctttaattataatagtctactttacgacattttctgagcattttctcttttgttgtatactgatattgtacgttataaaggaggattcacttatgttgaaaatattcacgacgcagttaacaggtattttttcccgcattcaggataaggaatctgacgcgattgaagatggggcgcggctgcttgctcaagcggtgatcagcgggcattccatttatttatacggagcaaatgagctgcagggcgtcttttttgaggccactgaaagcaaagaacccttcccatctgtcaaagcctttccagaaagcgctgaggaagtgacagaaagcgacagggtgctgatgttttgctcagggacgggcacagccgaagaacaggcgctcgcaaaagagctttatgaaaaaggtgcgggagtcgtatgcgtatcgcccgcagccaaagacagtgcgggaatagaacagtattgtgatgtgcatattgattctaaattaaaaatgccgcttgttccggatgaagacggcacccgttacgggtttccctctttaatgacagcactgtatgtctatcacgctttatcgtttacactaaaagaaattctgcaagagtatgcataatatcttattgtacatgctggaacttgccggaaacaaataaaaaagacttgcccgcttttgacaaacggcaagtcttttttattacttctgatttgcagcttcgacagacgctccgataaagcctttgaatagaggctgaggtcttgtcggtcttgacttgaactctgggtggaactgagaagccacgaaccaagggtggtctttcagctcgatgatttcaacaaggcgtccatcagggcttgtgcctgagaatacaaagccttgctcttccatttgctgtctgaattcattgttaaactcatagcggtggcggtggcgctcgtacaccacttcatcctgatacacttcaaaggctttcgtgccttcttcaagcttacaagggtaaaggccgagacgaagcgttccccgagatcctccacatccttttgttcaggaagaagatcaatgatcgggtattgagttgacggatcaatttccgctgagtgggcgccttttaagcccaatacgtttcgtgcgtattcaatagacgccacctgcatgcccaagcaaatgcccaagaacggaatgttgttttcgcgcgcgtattttgtcgcgacgattttaccttcaacaccgcggtctccgaatccgcccggcacaatgatgccgtctgttccgcttgtgagttctgcgatattgttttctgtcacttcttccgcgttgatccatttcacttttacatctgcgtcaaacgcatagcccgcatggcggagagactcgacaacagaaatgtaagcgtcaggaagctcaacgtatttgccgacaaggccgattgtaatcgtttgagacaggttgctgactttgttaacaagctctttccattcggacatttccgcttctttgcatgccaatttcatgtgctcgcaaacaagcttatcaagcccttgtttttgaagctccagcggaatggagtaaaggttgtccgcatcttcacattcaataaccgcttttgtatcgatgtcgcagaaaagcgcgattttatctttcatatcttgagaaatcggcatttctgtacgaacgacgatgatgtttggctgaatgcccaagctgcgtaattcttttacgctgtgctgtgtcggttttgtttttaattcaccagcagctttaatgtaaggtacgagcgtacagtggatgtacattacgttttcacggccgatatcgctcttcatttggcggatcgcttcaaggaatggcagtgattcgatgtctccgacagtaccgccgatttctgtaatgacaacatctgcgtttgtctctttccctgcgcggtaaacacggtctttcaattcgtttgtgatgtgcggaatgacctgtacggttccgccaaggtaatctccgcggcgttcttttttaagaactgttgaatagattttacctgttgtcacgttgctgaatttattcaggttaatgtcgataaaacgctcatagtgaccaaggtccaagtctgtttcagcgccgtcatccgttacgaatacttcaccgtgttggtacgggctcattgttcctgggtcaacgttgatgtatggatcgaatttctgaatcgtcacgttcagtccgcggtttttcagcaaacgccctaatgaagctgctacaataccctttccaagtgaggatacaactcccccgttacaaaaatatatttcgtcatttcgtttgctcctctcttcgctcttagctacatttttaaaatgtactattttataaaaaatcatttagccttttaaatgatttataagaaaaatgaggggtgaaaataagaaagctccctttcaatttcttgaaagggagcataacgtactatgttctctcttcgtttttgaagagcccaaaatacatactacatagttcgactatgaaagtcaagatcgttttgaagatgaaatctgatactatttaatttcctcttcttcatcatcatagtcttcatcatcttcatcaataatatcttcttcgatctcaagatcatcgtcgtcttcatcaagatcttcatcgtcaaaatcgtcggcttcaagatcgagttcttcctcaacttcatccaaatcaaggtcgtcttcgtcgatctcttcaaactcgtcaagatcaagatcttcttcgactgctttcttcgcttttttctttttcgccttgactgtcggctgagtttcttcatcaagctgatcatacggataccagctgcgaagccccacgtctggtcagaaagcgccaggaagcggccgtcaatgtttaaatctgtataaaattgagcgatgcggtctccaagctcttcttttttcacgccgagcaaagatgcgatttcatttaaaagctcctgaaaaggaactggttttttatgttcttcaaataattcgtgagcgatttcaactaaagccatttccgttagctcttcctgtgaatattgtttgatacccaaggtcggacactccctttctattacttatatgtatctgttttatcaataatgaaagcgattttgtatcgttcttatacaaaccatacctctcattataaacaaaataaaacagaatatgctacccttaacagcgttaatttaaataattttacaagagtgatccgactgagagatgttttccgttaatccgcgagcattctggagatgaccagtctttgaatttcttgagtgccttcatagatttgcgtgatttttgcatcacgcatatagcgttctaccggataatcttttgtatagccgtagccgccgaaaatctgcacggcttcggttgttaccttcatcgccgtatccccagccatcagtttggacatggcggaagcttttccatatggaaggcccgatgattctaaccacgcagcctgataggtcaatagccttgaagcttctatcattgtcgccatatccgcgagtttaaaagcgatgccctgctgctcggcgatcgattttccgaattgctttcgctcttttgcatattgaagcgccgcatcaagcgctccttgggcgatgcctacggcttgtgcagctatgccgtttctgcctccgtcaagcgtcttcatcgcgattttgaagccttctccttcttctccgagacgctttgatgcgggcactacacaatcttcgaacatgatttccgttgtcggtgaagaacggatgcccagcttcttttctttcttgcctgtaaaaaatccttcaaaatccttttctactataaaagcggtaatgccttttttctttttctcgggatcggtgacggcaaaaacaatgtaaatatcagcaacgccgccgtttgtgataaacactttggaaccatttaacacatagtcatcgccgattcgttcagcagttgttttcatgctgccggcgtcagagccagaccctgcttcggtcaaagcgaatgcgccgattttctctccgagggccagctgtgttaagtactctgtcttctgttcctctgtcccaaaggcaaacagcggccagctgcaaagagagatatgggcggaaagcgtcacaccggtggaggcgcacacttttgacagctcctccaccgcgatgacataggctaaatagtcacttccgattccgccgtaatcttcaggccacggaattcccgtcagccccagatttgccatttcccgaaacagctcgcgatcgaagcgttcttgttcgtcccgttctgccgctgtcggggccacctcatgcttcgcaaaatcgcgcaccaattttcgtatcatctcatgttcttctgataatgaaaaattcattgcttctcccccattttcagatcagcgcctaaaacggattgagccagaagctcgactatgtcgtacgttttgacttggtcttcagcttccttcgcctttgtgccgtccccaagcattgtgagacagtacggacagccggaactgatcaccgatgggttgactgcgagcgcttgctctgtcctggcgacgttaatcctgttgcctgtttcttcctccatccacattaatcccccgccggctccgcagcacatgccggtttcccggtttctctccatttcaacaagctgcacgcccggaatggctttcaaaatctctctcggcggatcataaacttcattgtaccggcccaaatagcacgaatcatggaaggtaatcgtctcatgaagcgggtgctgcggtcttaattttccgtttttcacaagctcggccagcacttctgtatgatgataaacctcgccttcaaatccgaaatccggatattcgtttttaaataaattgtatgcatggggatcgatcgtaacgatttttttgacatcatttttttcaaattcagaaatattcttctcagccagctcttggaacaaaaattcatttccgaggcggcgcggcgtgtctcctgaatttttttctttattgccgaggatcgcgaaggacacgcccgcgtgattgagcagcttggcaaaggaaattgcgattttctggcttctgttgtcgtaagaccccatggagcctacccagaaaaggtactcaaattcttttccttcttttttcatttcttttacagtcggaatctcagcatccggcgcctcgtcacgccaattttcacgttccttgcggttgagtccccacggattcccctgccgctcaatacttgtcattgcgcgctgggcgtcactgtccatttttccttctgtcagtacgaggtagcggcggagatcgatgattttatccacgtgctcattcatgaccgggcattgatcctcacagtttcggcaagtggtgcatgcccaaatttcttcctctgtgatgacgtcgccgatcaagcttggattgtaatcaagcgccgctgcggcttcctgcgatccgctgcccgctgacgaagcagccagctgattgcctctcgtatgccgaaacgctgctgcgggcacccatggggagcgcgaggtgacggcagcgcctttttccgtgagatggtctctgagacgcaaaatcaagtccatcggagaaagcatttttccggtgcctgttgcaggacacatattggtacagcggccgcactcgacacacgcgtacagatcaagcagctgagactgtctgaaatcctcaatttttcccgctccgtagctttctttcgtttcgtcggtaaaatcaattttttcaagttttccggcagattccatccgattgaaaaagacgtttgccgggccggcgattaaatgggcatgcttcgactgaggcacgtacactaaaaagctaagcaagaacagaagatggatccaccaagcgatatagaaaatcaccgccgcgcctgttttcccgacaccgctaagcataaacgcaatacctgaggcaattggctcgctccaagaaagcccatgctcatgccaaatcagattcatcccgttcccaagcagaacggtcagcattaatcctccgataaaaatgagaacgagtccggctttgaaaccgcgtttcagcctcacgagcttttcgatataacgtctgtagaatgcccacccaacagcaattaaaatgagaaacgtaacaatttcctgaaaaaaggtgaaggcgggatagacagggccaagcggcagattccgatcgggagccagtcctttgatgataaagtcaatagctccaaactgaaccaatataaatccgtagaaaaacatgacgtgaatgactccgcttttcttgtccttgagcagttttttctgcccgaatacattcacccaaatggcgtgaagccgttccttgaaccgttgatcaaattgttctttctggccgagcttgatgtaggccagtctcgttttgaccaagtacacaaacaaatagacagcgtaagcggttacaatcagaaataataatgcatttgcgatgagaaagccgctcattccaattccccctttttactgataaagaccgcgatcccctaccccgaatctgtataagattatctttatgataaataatgaatgagtgttcagtcaataattaaattcctgctgttcgggcacactacctttactacggaaaggagtgccggtatgaaggtatttatcgtgattatgatcattgtcgttattttctttgccttgattctgcttgatatcttcatgggccgtaccggatacagaaaaaaggcgtacgagcctgttttttcaaaaaagaagagtgacatcgaattgatccactgcggcgctgatctcgttgagcggatgatgaatgatattcgccagtccgcctcttctgttcacatgatgttttttattatgaaaaatgatgaggtcagccacaatatgtataccttgctgaaaacaaaagcccaagctggcgtctccgtttatttacttctggattgggctggttgccgggcaattaaaaaaacggcgctgcagacgatgaaaaatgccggcgtccatgtccatgtgatgaatcgtccccgttttccttttttcttttttcacatgcaaaaacggaatcaccggaagattacagtgatagacggaaaaattggttatatcggcgggtttaatatcgccgaagaatatcttggaaagaaggcgaagttcggcaattgggaggattatcatctgcgcatgatgggagaaggcgtacatgatcttcaaacgctttttgcttctgatctaaaacgaaataccggaatccaactgggttcggatgtttggccaaagcttcagcaagggactatttctcacaagatatatgcgaccgacggttattcccttgaaaacaaatacttggccaatattgcccaagcgaagaatcgccttacggtttgcacgccttattacattccatcaaagccgcttcaagaggccctcattaacgcaagaaaaaacggcgtatccgtgagaatcattgtaccgatgaaatcagaccatccgctggtacgagaagcggcttttacgtattattcggagctcttggatgccggctgtcttatttatcgttattatcaagggttttatcatgtaaaagccctcatcatagacgaccacctcagcataatcggaacagccaacttcgataaacgaagcatgtttttaaatgaagaggtgaatgtcgaaattgatgacgaagcgtttacaagtgaagtctatgccacgattgaggaggatatgaaaaagtcggagcggctgacgatggaggatttcagcaagcgcacattcaggcagcgcccggcggaatggctcggcagggcattatcttatttcttataaaggagagttcctatgattttcagattcgggttcgtttcaaatgcgatgagcctttgggatgcgtctcccgctaaaacattgacattcgcgcgttattcaaagctttcaaagactgaaagaaaagaagcgcttctgactgtgacaaaagccaatttgcgcaatacgatgagaacccttcactatatcatcggacacggcatccctttgtaccgtttttccagttcgattgtgccgctggctacgcatcccgacgtgatgtgggattttgtaacaccgtttcaaaaagagtttcgggagattggagagcttgttaaaacccatcaactgcgaacaagctttcatccaaatcaattcactctgtttacgagcccgaaggaatccctcacaaaaaatgcggtaaccgatatggcgtatcactaccgcatgcttgaagccatgggcattgctgatcgctccgttatcaacattcatattggcggcgcttacggaaataaagacaccgccactgcacaatttcatcaaaatataaaacagctgccgcaggagatcaaagagcggatgacacttgaaaatgatgataaaacatatacaacggaagaaacgcttcaggtctgtgagcaggaggatgttccgtttgtctttgactttcatcatttttacgccaatccagacgatcacgccgacctgaatgtagcactgccccgcatgatcaaaacgtgggagcggatcggccttcagccaaaggttcacttgtcttccccaaaatcggaacaagcgatacgcagccatgccgattatgttgacgccaactttttgctgccgctgttggaacgctttaggcaatggggaacgaatattgatttcatgattgaagcaaagcagaaagacaaggcgcttctccgtttgatggatgaattaagctccatccgtggtgtcaaacgcctcgggggcggtgcgctgcaatggaaatcataaatgtgcaaaaataggtttacgacttgtcagctttgggaacttaggctatataagacaacaatcgatggaggagaaagatcatgaaaaatatcaagtctctgaaagtagccgcacaggcctttactttaagaaatttgattcatctttataaaatgtgccattccggaagccacgaggtttatatttattcaaagaaaacgatgtgcaaaatcaaaagcttaattgagcttgaaacattccgcatggctcataatgaaaaggaatatctgatcgtagttgaaggaacaaaagcatcacagctcattgaaaaattccaaaatctcatcgagcctgctgagagagaagcgctctaacttacatacaaaaaaggatagacatctgtctatcctttttcttatgctcttacataatggagctgaaccgcttgtccaaattgttttgtcccttttaaccgcagttttgtttcatttgttagttcgtgaaacagcgggatgccgcttcctaaaacgacgggaataacagtgatgatgaattcgtcgatggcatcttctttcataaagtcattcacaagctctgccccgccagctatccagatgtttgagcctttttcctgtttcaaacgggcagtgaaggctctggctccctcattgataaacgtcacatgttcatcttgataactgtcgggggatcctgtaaaaacatagcaggttttatcctgatacgggaaaaccggtgttagcactttaacgtgctcatatgtgctccgccctagaatgactgtatcaacagtctgataaaaatcactgtagccgttgtcaccttcaccttcaaattcatccagccaatcgatgcttccatcttcttttgcgatcatcccgtccaatgaaacagcaatgtacagcacagtttttctttccatgttctcctcctatcgatgcaccatttgcccgaattgcgcttgatgcagcctgctgtataggcctccggcttcgatcaggtcttgatgacggccttgttcttcaataccgttgtttgtgacgactacaattctgtccgcgtctttgatcgttgccagcctgtgggcgatgacaagcgtcgtgcgcccctcagacaactcttgaagggccttttggatcgccgcttccgtctctgtatcaagagctgaggtggcttcgtcgagaatcaagatcgacggatttttcaagaacatccttgcaattgacagacgctgtttttgcccgccggaaagcttcacgccgcgttcgccaatcatagtatccaacccatcgggcatgttatggacgagctcttccagatgcgcctgcttcacagcttgccaaatgtcttcttctgatgcgcctaatcggccgtaggcgatattttctctaagcgtgcccgagaataagaaaacgtcctgctgcacgacgccaatctgcccgcgcaacgaagaaagcgtcatgtcttttatactgatgccgtcaatcgtaatgtcgccctccgatgcttcataaaaacgcggaagcagactgcaaagcgttgatttccccgcacctgacggaccgacgaacgccaccgtttcccccgcttgaatggataggttgatgtcattgaggacattgtgatggtcatcatagccaaacgaaacatgtttatagcggatattgcccttcaggccggaaacatctctcgcatcaggtgaatcctgaatgtccggctctgtctccatgagctccatatagcttttgaaacccgcgatccccctcggatacatttcgataatggcattaattttgtcaataggcctgaacagcacattcgtcaggagcacaaacgccacaaattccccgtacgataaggagccgcgaatgacaaaccacgtcccgcacaaaagaacaaacagcgtgacaaaccgagtcagcatatagctgattgacccgtttttcgccatgattttgtaggaagaaagctttgtggcacggaaacgctggttgttgacggcgaagcgttctttttcaaatgcttcatttccgaacgcctgcacaagccggataccgccgatgttattttctacacgcgcgctgaagtctccgatatccttgttcagcgtggtaaatgctttggtcattcttttgttgaaataaagcgctagccaaatgacgatcggcataatgataaacgttaataaagcaagctgccagttaataaacagcatcactccgaacgccccgagaatggtcatgaccgcaatgaataagtcttccggtccgtgatgagcgacttcaccgatatacattaaatcgttcgtgagcttcgacatcagcgttcccgtcttgttgttgtcgtaaaatttgaacgagagcttttgcaaatggtcaaaaagcgactttctcatatcagtctcaatattgataccaagcatgtgtccccagtaggtcacgatatactgaagagccgagctgagcgcgtacaccgcaaataacccgattgaggtcgcgatgatcagcccccagtccctgcccggcagcaaggtatcaataaaataattgacgatcaaaggaaaactcagctccattaaacctcccgcgatcgctgagaaaaagtcgagaaagaacaacgttttatatggtttataatatgaaaaaaattgccgcagcaccctatcttccccaatgtataaataactgataatatttctcaattatactatacacgggctgttttgaaagatcagatttcttttttcttacagaacacctgaaaacaggcgggcaaatgactcttttgtccggtcagccacgcctcttttataaaagccgacagggctgagcttttcactttcctgcatatcctcttcaaaatggatctcaagggttcggatcgcttcggcatccgtgaagaacacattcacttcaaagttgagctgaaagctgcgcatgtccatattcgcggtgccgacggaggcgagatcaccatcaatgatcatgactttttgatgcatgaagcctttttggtaggagtacacttcaatgccctcaagaagcagctccgggaaataggacctcgacgcgtattgggtcaaaaagctgtcgttcttctccggcaccataacccttacctctacccctttgtcgccgctgcttttagcgccgtgcgaatggattcattggggacaaaatagggcgtggcgatccatattgatttctgcgctgaagaaatcatttcataataaaggtcgctcatgctttccttcatgtcagggcctgtcgcgacaatttgataaatgcctcctccttccacgggaaccggggtattgtactcctcttgatcaattagcacttcattggagacgtattcccaatccagcataaagatagcgtggagcgtttgcacaatttccccctcaagccgcaggtgtgtatctctccaaaatccgatgtacggatctctgctgatatattcctttccaacatttaatccgcccacaaaaccggttttcccatcgatgatcacgattttccggtgatttctgaaattcagcttctggttgaaaaacccgtatttcagcggagaaaacgggacgatgtccacccccgcttgtttcattctcataatatctcttcttgccagcttcatgcttcctgccgcatcgtataaaaacctcacctcgacaccctggcgcgctttctccatcataatatccatcatgccgcgtccgagcatgtctgatttaaacatgtagtattcaatatgtatgtaagattccgcttttctcattgctttgaaaatgtccgggaaggtttcttcgccgtttttcagcactttgatgttgcttttcgtattgatattcatatgggcagccctgatggaatatgtaaagaacctctcttgattgtccttcagccctgtcacttcgggcgtttcctccttgtcaaacagcttcctgagcttttccctgttgtacattcgttttgtcttaaacagctttccctttacataaagctgtcccgaaaacagataaaacacgtagccggcgattggaaaaaagacaagaatatggatccacagcagcgtgtgctgcgaggtgcggttttcaagaattaatgaatagatgctgaacaaaataatgcttatatagcaaagcaatcctccgtaaaactcaagcctggaaaccggaaaaaaccaaatgacatatgccccgatgagcatcatatataaaaagaaaaattccagtctccttttcagcatcctgattctctccaatctgattcaattacctctgtattacctcttttttctaatcgataaaccttgtaagtaaataacctctccgccgaaggaggagaggtttagaaaaaactaactgtcaaggaattcatccgcatcgtttctgcagaaataaagcaagactataggcaacgccgagtgacaacatgagcggcaggctgaacccgctgagcactccggcaagcgccgaaaaagaggcggcgctgtgactgcaaatacggtggatagagtgaatttgatgcccattctgatgagagaaaatatataaaacgggatattgatcagaaagaaaataaggagttagtcaggctgagtcataatctgctgttccgccggtttaaaatgagtaaaatccgttttattcttgatgttatttccaaatacaaacacaacaggattcccggccgcccagccattaccttggcagaaaaaaccccctcttgcaagggggattttcacgagcgtttccgatatacaacgtagctgcgggtcagatacttgagcggcagactgaacacatgaaccaatctcgtaaacggccacaggataaaaacgacgtatcctatcacaatatgaaacttaaaccatagcgggacactctccatcaaagaggcatcaggcctgaacaaaacgatttccctgaaccagggcccgactgtggtccggtaatcgaagcctttcgaatcaatgttgagaaacgtggccgcaacgcctgacagcatcatgaacagcagcaggaggagcgtaaggatatcggatggcgagctcgttttgcggattcttttgtcaaacagccttctgtacgtcaggatgacaagtccggtacatgccgcaatgcccgccggcaagccagcgccaatcgccattttgtgatacatatgctctgaaatgccaagggaagcatacacgccttccgggatcagaatccccatgacatgcccgccgacaacgcacagcagtccccagtgaaaaagtgtgctgcccgccgcaagttttttcttttctaacagctcgcttgatttcgccgtccagccaaattggtcatgctggtagcggtaaatatggccgccgataaagatcgtcaatacaatgtatggcataataccccagaggatctgcccgctcatgcctgaacagccccttcaacgctttcacgtacgccgatgttttcaagcgcggccagcagcacgtgcagcagttcagcgtatatactgtcatttttttcgagacgggatgccagctccctcacattggacagatatttctcaaacacgcttctcgctgcttcaatttctgcagccgcagcaaattccagcatcagcggcagataatcaggcagctctttctctgtcggcagaaaaccggattgttcgtatgcgttttttaaatgcagcaattcaatgccgcgttccctttgctcgcccgagttaaagtaggtgacatacatatttgtttttttcccaaagtcgaatgtatagacatagtgttcaatcagcgcttccggtgaaaagctggctgacgcctcgaaaaagtgcagcagcttcttccggatttgccggttgccgatttcatggataagagccttccattcgggaatctcggctctccactcttcatccggataagagagaagagaggaaagagcggagaacgtaatttgccggtctgtggtgttcatcttgttacacctcatttatcaaaagttagaaacaggagccggggccgcctgaaaatgataagccgcagctcccttgttcagcatataaatctgaaacttcttctcgatgactgctcggtatcacaaagcggtcatcatatttggcaatcgcaagcagccgatacatatcttcaatttgctgttctgttaagccgacactggagatcagttccgggtcgattgatttattcgtctggatcgctctcatatactggcgcatgacagacattttctttaacgttgaccgaatatgatccgtatcaccggctgttaacagctgcgccaaataatctatcgggattctcatttggtcgatagccggaaaaatatcttctgcggattgccggctgccttttccttcaaagagattcataatcggactgagcggcggaatgtaccacaccattggcagcgtgcggtactctggatgaagcggcagcgcaatcttccagtcaatgatcattttatagatcggcgattgctgcgcagcctctatccaatcagacggaatgccttgttcttttgccagcttggcaacctcaggatcatttgggtcaagaaaaacgtccaattgtgaatggtagagatccttttcattttcaacagatgccgcttcctccactttgtccgcgtcatacagcatgacgccgaggtagcggattctgccaacacacgtctcagagcagatggtcggcagtcccgcctccaaacgcggaaagcagagtgtgcatttttccgctttgttcgtttgccagttaaaatagacttttttataaggacaggatgatacgcaatatctccatgaacggcatgcgttttgatccacaagcacaatgccgtcctcctcgcgtttgtacatggcgccggatggacaggatgatacgcacgccgggttgatgcagtgctcgcaaatacggggcaaatacatcataaagacctcatcgaattctgttttgatcgattcctccatcttttgtacgttgggatcttcaagtcccgttatgtggccgcccgcgagatcatcctcccagttcggtccccattcgatattcataaaatcccccgtcaaggacgatttcgggcgtgctaccggctggtgttttttctgcgggctattcgttaatgtttcataatcatagttccagggctcatagtaatcatcaatcgacggctgattcggattatagaaaaggcctgcaagccgattggttttcgagcccgatttcagctcgagctttccttttttcaatgtccagccgcctttatatttgtcctggtcctcccattgcttcgggtagccgatgcccggctttgtttctacattattgaagtacatatattccgcaccggaacggtttgtccacgtgtttttgcaggtgacgctgcacgtgtggcagccgatgcatttatccaagttcatgaccataccgatttgcgctttaatcttcaagccaatcgacctccttcagcttgcggatgacgacgttcaggtcgcgctgattccccgttggaccgtaatagttaaagccgtagctgagctgggcgtagccaccgatcatctgtgtcggcttgacgtgaatccttgtcgggctgttatgggtgcctccgcggttattcgtcagctttgttcctggcacgttgatgtggcggtcctgggcatggtgcataaacgccattcctttaggaatccgatgagacaaaacggctctcgcgacgacaacaccatttcggttaaagcattcaatccaatcgttgtctttgatatccgtgtcctctgcatcatctttattcatccacacggttggcccgccgcggaacagcgtcagcattggcagagaatcaaaatacatgctgtggacagaccatttattatgcggcgtcaaataattgaggacgatttcttttccctcttgatcaggccgcttgctcagaaacgggcgatgctggaggatcggtttgaatgtcgccatcgtttcaccgaattccatcatcagttcatgatcgacataataggattgtctgcctgtcagcgtccgccacggaattaatttttcaacattcgttgtaaacggcgaatacctgcgccctcctttttcagagccggaaaacgctggagacgtgatcaccgttttcggctgggctgtaatttgttcgaacgtaaagcattcttcctcgcgttcttccgccaggtctttcagcttcaggttcgtgatgttttcaagtgattcccatgcttttactgcgacctttccattcgaagtggatgatagggttaaaatcgcttctgctgcctgctttgcttcacttatatttggacatccctttgcgacactgtccgaggtgatttctcccaatctctgtttgagtgattcatattcatcggctattgaccagctcatcccttttgttccgctcggctttaaagcaacgttcggaccaagtgcagtcattttatgaaaaatgtgtttgtaatcccgttcaacgacttggatgttcggcatcgtttttcccggaatggcttcacattcgcctttgctccagtcattgattttgccgaatggctgggccaattcctgcatggtgtcatggaggagcggcgtcgcaaccacttctttcacgggctccatatcgacttcttctgccagatcggaaacggcttttgacagcgccttgaaaatatcccagtctgacttcgattcccacggagccgagatcgcaggagcaaatggatgaatgaacggatgcatatctgtgctgctgagatcgtgtttttcataccatgtcgccgccggcagcacgatatcggaatacagcgccgtaccggccattcggaagtcaagattgattaacaagtcgagctttccttccggcgcctgctcccgccatttgatttcttcagggcggatgctgtcgctatcgtcattcatcaagccgtttgtcgtcccaagcaaatgcttgagaaaatattcatgcccttttcctgagcttgagatcagatttgcccgccatacgaagagatttcttggaaaattcacttcattatcaggatcttcaatcgcgaatttcagttttttctcttggagctgtgaggccacgtacgcaccaacgtcttcaggtgtttctgcccctgctttttcagcttctttatacagatcgatgccattttgattgaaagtcgggtaagacggaagccaccccagccgcgcggccagcacattgtaatcagcgtggtgcttgtagcgggatgacgcagcaatcggtgatgccaaatcactgatcggctggtcctcataacgccactgatctgtcgcaaagtagaaaaatgaggtgccgttttgcagcttgggcacgccctcccagtcctttgcagttgcaatcgtctgccacccttcagcaggtcggagcttttcctgccccacgtaatgggcccagcctccgccgtttacgccttgggcgcctacaagtaaaacaagatttaacaccgctcggtagatcgtgtcggagttgaaccagtggttaatgccggcccctacgataatcatggaccggccgtctgtatcgatcgcattttgagcaaactctctggcaatcttaacgacagcttcttttttgattcctgtcatttgttcctgccaggcaggcgtaaacggctcaggatcatcataggagacagccaatcgttcgccgataccccggttcacgccgtagttagccagtatcaagtcaaacacggtcgtgatgtacgtttcttcaccgttcaggttcatttttttaataggaagatcccgctcgagcactttgtttccgtcatttgaaaaatacgggatgcgcaccgtgccgatttcgtcctctattcccagcacagagagacggggttcaatcggttccccggtttcttcatcaatcatgtgcaggttccatttctgctgcccgtcccagcgcgagcccattgtcccttggggtatggcaaatgaacttgtttgttcatcccaaaccgcaggcttccactgatcatgctttgtctgccgcccgatgtccttcgcatgcagaaaccgtcccgctgtgtatacgccattttcttttgacagggtgacgagaaatggaaaatcagtgtattgcttcgcgtactcaataaaacgttcagtttcttggttcacgtaaaattcctgcagaatgacatgacccatcgccatcgcaagtgccccgtcagtcccttggcgaatactcagccagtcatccgcgaactttgaggattccgcaaaatccggactgatcgaaatgaccttagcgcctttatagcgggcctccgccaaaaaatgcgcgtcaggcgttctcgttaacggaacgttggagccccatgtgaggatatagccggaattgtaccaatcactgctttccggaacgtccgtctggtcaccccaaatttgcggggatgctggaggaagatccgcataccagtcataaaaactgagcatagggcctccgattaacgacataaaccgggagcctgatgcatggctgatcatggacatggccggaatcggagaaaaaccgacgtttcggtcaggcccgtatttcatcactgtatacagcagagaggctgaaatcagcttcagcacctccggccactcagcgcgcacaaacccgcctttccctctcgcctgtttataggacttcgctttttcagggttttcgacgatcgatttccaggcttccaatggattttgatgttcttgcagtgcctcccgccataaattaatcagtacaccgcgcacgtatggatatttcacacgcagcgggctgtagatataccatgaaaaactggccccccgcgggcagcctctcggttcaaaatcaggcatatccgggcctgttgatggataattcaaattttgcccttcccacgtaacaattccatttttgacataaatattccagctgcaagaccctgtacagttaacgccgtgggtggagcgaacgactttgtcgtactgccatctgtttctgtatacattctcccaatcgcgatcttcgcgggtggtttggctatgtttatttgaatggtgttcgataggagagaaataattcaatctcctaaacaacggactccttttctttttcttcatgagagttcactccttccgagtcaggtgatgctaagttcactataaacagagacagcgtgtttccttgtgaactatgtcacacactctgcttttttcacaaaatgttcacacaaaggagaaggaaggctgcgttcaggcagaacgcttgggtcattagccgcctttcattcaaagatcaaaaaaaccggctctatttaagaaccgggctcagcgttttcatcctgtgatgtatgcagataccgcaaaaataattgataggaacaaaaaacattttgctgaagcatagccaaaaagttcatttgcagctgcggatggtaagacatcattttcttaaatatgtaatatgggatattgagaatcagaatgtctgaagtggcattgactgagataaagggcgataaataaagcccgcctttttcatcaatcggaaacacatcgcctttttcccacagcgcaacggttttcgacccttcagggagcctgctgtccacgaaacggacactgccttttaatacaatatagacagattgagaatgaagaaaagatggagactgatcacatgagccgcggataaacgtgccgtttttcagcaaggtttcgacaatggatagaggcacttcattaaacataggaagttgtttcagaaataataaatagtcacactgattcataggaaaacctcctgtgctaaggatagctttagtgtagctcgactgagcctgtacagcagtgatgtatttcacagcctgtatgatgaatgtcacttatcaggagggtgactgcatttataatgaaagaaaaaaggaggatttcgatgaaggcgctgattccgaagcagcacggcgcgtgggcgatgctgctgatcccatttttactcggcatggccaagggaggccccgttatttggcatattccgctcttcctaggctggcttttcctatacttagcggtttatccctttacgcttgccttaaaaaagaaacaaagcaaaccatatcaaaagtggatgtgttattacggttttcccgcctgctgctttttgatgatctcggtctttcataagccgcctctcatctgggtgggcgtttctttactgccgctgtttctcatacatatgtattttgcccgccgaaaaaacgaacgagccctattgaatgatgttgcaggtgtcttgttcttttgttcgggcgggtttgcgagctgctggctggggatgggaaccctcgacggctgggcttggtttattttcttgcagtctgctttattttttatcgggagttccttttatgtgaaatcggtgattcgtgaaagaaaaaacaggacacttgcatactggtcatggggatatcacctgctgctcccctttttatccgctcttttcggagcaggatgggcgtttctcgcttttatcccgagcagcttgcgggcatggttttttcatggaagagattggcccgtaaaaacgattggcattctggaaatcgtgaatgcctgcttcttttttgccgtcatgtgcctctttatgacaaggtaaaaaaacaaggacaccgctgtccttgtttttttcagtcaatattgcaaatctccagcgggcaattttcacactcaatctcacatcgtaaatagtcccgcttgtgtaaaataatttttccggattcgtctatcgaaataaccccttttttgcggagatctcccagcatacggttgatgctttcccgtgcagccgcacaaaactttgccaaatcctgatttgtcaggacaatgttaatcagaatgccgtcgcttcgctccactccgtagctgtttgataagcggataagggtagaatagagcgccccctttttgccatgaagaagcagatccctgattttggactgaatcttccggaggtgcgtgctcatccatttcatgaactcaaatgtcaaagcgccgttttggattaattctttttccagcttatttttattaatgacgagcacctcgccatcctctagcacttttgcactgagcatataccttggttcttcagtgaaaagtgttaattctccgacgatatcatgcttttggcagattctaagcgtcaggtcttttccatcagatgtcagcttgccgatttcaatgagtcctgattgaatcagaaaaagctcttctgcatccattccttctcgaaacaaatacgtgtgtttttccatttttcttttcgtgctgatcgattccagcaattcatgcagatcgctggaaataagatcactatcagatggtcgaacagagagaaaattcatgagctcacctcgaagaaagtcacgttgtgtgtttattgtaacgtgaattgatttgtacccatcgagaaaaaactaacaatcttgtgaatgccccagtgttagttgatgctctggctgtttctctccgtgtgtgttttcattctttcctgccaatacatccatatgacaaggacaaagctggctaacgccacctctgaaagcgccataaacccgatcgcgtactggcctgttgcctgaaacacactcgccaatatgagcggaggaaaaaagccgcctaatccgcccatggcagacacaatcccattggcaatccccgcttgcttggaaaaatagaaaggcaccagtttaaaaacagtcccgtttcctatgcctgagcagacagccacggttaatgatccaaacgtataaaggccaattgtcggcgagaacgataggataatgcctgataatgtaagcccggcaaaaacaaacatcaagatgcggagcgggctcattttatcagccaggaatccgcccgcaggcctgagcagcgtagaaaccgcaataaagccagccgtccgcaagccggcatctgcaggattcagcccaaaatgctccaccagaaagttcggcagatagatagtgaaggcgacaaaggcaccgaacgtaataaaataaaacaggctcagaaaccatagcacatgatttcggtaaacggctttgatttgagtcttaacagaaactttgaccttcttctcatgcctgtcgccgaacaaaacgtgcagtaaggcaaagacagccagcaaaaccagatacatctgcacggttgatttccacccgacggcttgagcgataaccggcgctgcaaatgtcgtaacggctgtcccgatatttcctgcaccgtaaatcccattgacgacaccgtgcttttctttcggataatatttcgggagggaggtcactccaatggaaaacaccgctcccccgatccctaagaaaaagccgcctgcgattaaatcaaacagagagtccgcgatactgatccaaaatacaggaaataaaagcaggatgaagctgaccataaacatgagccgcgcgccaaacctgttcgttaaataccctaaaggaatgcggagaagcgacccgaggatcacaggaatcgccgtcaccaaagaaatctcgcccttgcttaaatgaatatctaatgtgatttgggaaatgagtgatgaaatcagcacccaaaccataaaccctgccaccaagcttaatgactgtaacgataattgaatgtgttgacggttgatcatttggcttgcccctttcaatgattcaataatcagtcttatcatacaaaaactcgccaaacaggattgtgaattacatcacacgtttttctcataaaaaaaggacaaagcccgaagactttgtccttttgatcgtgattacattttttccggagccgatacgccgatcagctgaagcgcattgttcagcgtaatttgcgttgccttcattaaagccaggcgcgcgcggcttttctcttcattttcagggtcgatgactttctctgcgttgtagaagctgtgcagagcagaagccagatcataaatatagtttgtgacacggtgcggaattcgtttttctgctgcttccgccactgcctctgggaagccgccgatcgttttcagcagatcgtattctttttctgattgaatatggctgaaatcaagatctgccgccggtttaagtccctgctcttccccttggcgaagcatgctgcaaatacgggcatgcgcgtattgtgcataatacacagggttttcgttagatgttgatacagcaagatctaagtcaaaatccatatgggtgtccgcacttcgcattgcaaagaagtaacgaacagcatccaagccgacttcttcaatcaggtcacgcatcgttacggctttaccggtccgtttgctcattttcattttctcgccgtttttgtaaaggtgaacgagctgaatgatttctacttcaagcgttcctttttcatagcccagtgcttcgattgccgctttcatacgcgggatgtagccgtggtgatcggcgccccaaacattgatcagcttatcaaagccgcggtcaagcttgtccttatggtacgcgatatcaggaagcaggtacgtgtacgtgccgtccttcttgatcaatacgcggtctttatcatcgccgaacgtcgtggaacggaaccaagtcgcgccgtcttcttcatagacatggcctttttcgcggagcgcttcaagcgccgtgtcgatttttccattttggtacagtgaagtttcggaataccacacatcaaacggcacacggaagttttccaagtccttgcgaagcttgtccagctcgtatttcaggccgtattcacggaaaaacgcgaggcgttcactttcctcttcgttaacgaaacggtcaccgtattcctcagcgagacgctttccgatcgcaatgatatcctcgccgcggtagccatcctccggcatcggtttttccaatccgagcgcttcaaagtaacggacttcaacagaaagcgccagattgttgatttggtttcccgcatcgttaatgtagtattcgcggcttacatcgtaacccgcttttgaaagcacgttgcacaaggaatcgccgacagccgccccgcgcgcatgcccgaggtgaaggtctcccgtcggattcgctgatacgaattctacctgaactcgttcaccgtttccgatgtttgtttccccgtatgcttcccctgcttccagtacagacggaatcagctttgttaaatattgattgttcatatagaaattgataaaacccgggccggcgatatccagtttttcaatcgaagcctttcctttatcaaaatgagcgacaatctcttcagcgatttgacgcggcgctttttttgccactcttgccagctgcatcgccatattcgttgagtagtcgccgtgtgttttatctttcggtgtttctaaaacaacattgggaatctggctttcttcagccagtcccgctttcagaacggccgctttaatttcttctttcagcacgtccttcatttgttccgcaatgttcatgcgtgagttcctccctcatacgtgatcgtcatattatgtaaatgctcctgctcgtctccgacatgcatgtcatatgcgatgctgatacggcctttttcttcatcgagatcagattgaatcgattttgtgcttgttttcagctcaagctcaccaaatgacattttatatttagcaattgtggaagctcccgttacgaaacgctgattcattttgacagcgcctgacctcatgaccaggacttcgccttcgcttactttcacaatcgttttgactttgcctaagtcgtgttcttcataataagatagatacactttattttgttttacatagtaaaatccggtggtgcggaattcgatgacttcttggtttccgtcatcctcgatcacagacttcacatggagtgttatcggtgtctcttgcttcattctgacacgtccttttcatcattccactttgacttgaatagtataatcattcggtttgtaaacttcaactgcttctatcttaccatcattgctcatcagatttgaagataaacctcataaaaagcatttccttatatagaagagaaaatcatatcactaattacccttaggaaatgttacatttttccgaaatctatcatttgcttttcacatttttttcaaattatatgtattgaattagtaatttgatagttttaagataaaagtacaacatagatctgctagaaaaacaaaaaaagggaggattcaattatgaaaaaagctgtcattgtagaaaacaaaggttgtgcaacatgctcgatcggagccgcttgtctagtggacggtcctatccctgattttgaaattgccggtgcaacaggtctattcggtctatgggggtaaggatctcccaaaagggcatagtcattctactatgccctttttaagtaaattacaatttttaactaaaatctacctcttggatatacatacacaaccgtttttcatttgaatcatatgtataggggatggtattttgtttatagagcagatgtttccatttattaatgaaagtgtaagagttcaccagcttcctgagggcggcgtgttagaaatcgactacttgcgcgataatgtctccatttctgactttgagtatttggatctcaacaaaacggcttacgagctctgcatgcgcatggatggccaaaaaacagctgagcagattttagctgagcaatgtgcagtgtatgatgaatcaccggaagaccataaagattggtattacgacatgctcaacatgctccagaacaagcaggttattcagcttggaaaccgggccagccgccatacaatcaccacgagcggaagcaatgaatttccgatgcccctgcacgccacctttgaactgacgcaccgctgtaatttgaaatgcgcccactgttatttggaaagctcacctgaagcgctcggcaccgtgtcgattgagcaattcaaaaaaacagctgatatgctgtttgataacggtgtattgacatgcgaaatcacaggcggagaaatttttgtccatccaaacgccaatgagattcttgactatgtgtgtaaaaagttcaaaaaagtcgctgtcttaacaaacggaacactcatgcgaaaagagagtttggagcttttgaaggcttacaagcaaaaaatcatcgtcggcatttctcttgatagtgtcaattccgaggtccatgactcctttagagggagaaaaggctcttttgcccaaacttgtaaaacgataaaattgttgagtgaccacggtatatttgtcagagtcgccatgtctgtcttcgaaaaaaacatgtgggaaatccacgatatggcccaaaaggttcgggatctcggggcgaaggcgttctcttacaattgggttgacgatttcggaagaggcagggatattgtccatccaacgaaagacgccgagcagcaccgcaagtttatggaatacgagcaaaatgtgattgatgagtttaaagatctgattccgattattccttatgaacgaaaacgcgcggcaaattgcggcgctggctggaagtccattgtgatcagcccgttcggcgaagtacgtccttgcgccctctttccaaaggaattttcattgggaaatatttttcatgattcctatgaaagcatctttaactcccctctcgtccataaactgtggcaagcgcaagcgccgcggttcagcgaacattgcatgaaagacaaatgcccgttcagcggctattgcggaggctgttacttaaaagggctgaactctaacaaatatcaccggaaaaacatttgctcttgggcgaaaaatgaacaattagaagacgtggtccagcttatttaggagggaaacgatttgtcaccagcacaaagaagaattttactgtatatcctttcatttatctttgtcatcggcgcagtcgtctattttgtcaaaagcgattatctgtttacgctgattttcattgccattgccattctgttcgggatgcgcgcgcggaaggctgactcgcgatgagcattttggatatacacgatgtatccgtttggtatgaacgggacaacgtcatcttagaacaagtggatttacatttagaaaaaggcgccgtttacgggttgcttggggtaaacggcgccggaaaaacgacactgattaatacgctgacaggcgtgaaccgcaatttcagcgggcgctttacactgtgcggaattgaagcggaggccggcatgccgcagaaaacatcagatcagctgaagactcaccgttacttcgccgccgattacccgctgctatttacagaaattacggcgaaggactatgtgtctttcgtccattcgctttatcaaaaggatttttcagagcagcagtttgccagtttggccgaggcctttcatttttcgaaatacatcaacaggagaatttcggagctgtccttggggaacaggcaaaaggttgtattgatgacaggcttaatgctgcgcgctcccctgtttattttggatgagccgctcgtcggtttggatgtggaatcgatagaggttttttatcagaaaatgcgcgagtactgtgaagcaggcgggaccattttgttttcttctcatctgctcgatgtcgtgcaaagattttgtgattatgcggctattcttcacaacaaacagatccaaaaggtcattccgattggagaggagaccgatctgcggcgggaattttttgaggtgatcggccatgaataacataatccctatcatgtctttgctgttcaaacagctttacagccggcaagggaaaaaggacgccatccgcattgccgcaggccttgtcattctggccgtgtttgaaatcgggctgatccgccaggccggcattgatgaatcggtgttgcgcaaaacgtatatcatactcgcgcttcttttgatgaacacatatatggtgtttctttccgtgacatcacaatggaaggaatcttatatgaagctgagctgcctgctgccgatttcttcacggagcttttggctcgcccagagtgtcgttttgtttgtcgatacctgtttgagaagaactttattcttttttattttaccgctgttcttatttggaaacggaacgctgtcaggggcgcaaacattgttttggctcggcaggttttcgttttttaccgtttactccattattttcggagttgtgctaagcaaccacttcgtcaaaaagaagaacttgatgtttctgctgcatgcggcgatattcgcctgtgtatgtatcagcgtcgctttgatgccggccgccacgcttccgctttgcgcggtgcatatgctgtgggcggtgatcattgactttcctgtctttctgcaggcgcctccgcagcagggcaagatgcattcatttatgcggcgatctgaattttcgttttacaaaagagaatggaaccgatttatctcttctaaagcgatgctgttaaattacgcggtaatggcggtattcagcggcttcttttcgttccagatgatgaataccggcatcttcaatcagcaagtgatttatatcgtgatttccgcgcttttgctcatctgctcgccgatcgcccttttgtactcgattgaaaaaaatgaccggatgctgctcatcacgcttccgatcaagcggaaaacgatgttttgggcgaaatatcgcttttattcaggcctattggcaggcggatttctccttgtcgtgatgattgtgggtttcatcagcggccgtccgatttcagttctcacttttttgcagtgtattgagttgctgctggcgggagcttttatcaggttaactgcggatgaaaaaaggccctccttcagctggcagacggagcagcagctatggagcggtttctcaaaatatcggtcttatctgttttgtcttcccctattcttagccacattagccggcaccgctgtatccttggcggtcattccgatagccggtctggtcatagtctattacctgcaaaaacaggatggtggtttctttgatacaagcaaaagagaacggcttggaagttaacctgctgaagactcatcaattttcaactatttcaatcgccgcgagctttctgaaaccgatcgaaagcgcggcggaacctgaggaagaaacaatttatttttacggcgccgccgcatacctgaaggagcaaatcattgacgcttttggttatgctgccggcagccgtttcatgtactcagcgaatctctttttgatcagcagctgaaaacctgcgggacccgtttgattcacccattatataacgggaatcttcatgttgacgccctgctgaaaacttttgcagacttgtctttcccttcttctctttcattcgaagcagttgaaaaggccaggaatgagctgctgctgagaatcgaaaagaaatttactgatcccttctcctactcggcggcgcgcttggctgaggaggtcttcggaaacccgatgtacggcacaggcatgtttggccggagagacaggataaaggcgattcatcctaaacggtttctcgacgcaacggactttatcgttgatttagtgtcccagcaaaaacagctgaacatattgggacaagtacaagcatgtgatgttcggggacatgccccgcaaacgtccgctgtaacgtccggaagaatacccgtaaaccggcatgtttttgaaacagagacacgcagcgctgcaggtccttccgtcttgacactcggatttgactgcggagagatgaaagatgccagcgattatatcaaaatacagctaatagacggattactgggaaagtacggccattccgctttattcaagcacttcagagagaaggatctggcagtctatcacgttatcacccgttacgatgtcatgaacaatttgctgcttgtttcaatatgtacagatcagcttcatgagaaagacattccccgcgcgttttggaagctgtctcagcttttcatacagatgagcgggaactagaacaggcaaagcagtttttacgcaatgaattgctgctgcaattcgattctcccgaaggtctattggcctatatggggatcctgcgccgcttctcctgcacgaaagaagccttgctggatggcatctcagcggttacataccgtgatgtattgcaattcatagcgaccatcaattatatcggagctcatgtagtaaggggatgaagagatggaaaagaaagcattttttcaacagctggatgaacgaaccgatatcagatacacagacagcggactaaaaatattcagattgaaattccccctcgcccacctgcggctgtgcaatgtaaaaatcgattttggaagccgggatgtatgtttacgggcagaatccggtgatacactgcttccgtatggcacagcgcattttttagagcatcttcttttctggcataacggccgcaatctgtacagtgatttttttgcgcatggcgcgcttttaaacgcattcactacctacaccgataccaatttcatgtttacctcattaccggatcggctcagacaaacgatccccatcctgcttgatgctttatggaaccactcatttgacaagaagattgtcgctcaggaaaaagctgtgattacaagcgaaattcaaacagcacaccttaaccatcagctctcatatcattatcagctgatcagcatgctttctccctcctcaccagctgccgttttccctgcaggcagaatcgaagatattgaggcgctggacatcaatgatttacaaaaagcctataaggctgcctaccaagcccatcggatgacgctgtttttgattgggggctcagaaaatacagaaacgcttttgcctcctcacctccagctggaaaagcgtccggattatcatgctgaaagaaaaatcatcccggcatgccctccagccctctcacaaaaaatggtgctgggtgatgaggagcggatggaagatacctggaccggattacagatcggcgcacttctcaggcaaaacgatctgttgacgataaagctttattgggatatcgcgtctcgtattctatttcaattagattcaccgttttttcaagagattcagcaaacgtaccgcctagaaatcgatcgcttgtcagccgagacttatatatatgaggatggcggtttcttgatccttcacagtcaagggacccattcttcagcttatatcgatgtcgcatcatactatgtcacgcagcagaaagaacaggttacgtcctggcttcaatacggcaagcactctttgactgacgcgatcatttatgacagcgattatgtgcgtaaatgcttcgagtgggcagccgagtgtgacaggtgcgattgctcgtttcttgacatgtaccacatcattcaagatatggatgcgcaggttttcttgtctctcattgatgcaatggcatcttctaacaaagcgatcattcacgtttctcagaaagaggcgatcagacaatgaaaaaaagcactgtctttacccttttattgctgcttataggtatggcggcttattccttcggctgggttcaggccgttgccgaagccgccgcccaatatgtacagatgatcaacaatgacgctgtgcggctcgggctgctggcttgtaccgctgccctcctgatgctgcctgcttttctctatcttcattatgtcacccaatccgtgaaaaacatgacagcagcttttcagaaactcacacagtctcatcaaagctgctgtgactttcagcaacacaacttgtgcagccgatatgcagaagacgtcaaatcgctgcgtgacagctataaaaacgtccgccaaacatacgtgatggctgccgtgttgtgccaagtcttcatattcggctgcatgttcgaaatcgttaaagccgtccctttccgccttcatacgccccctgccttttcaatgggacttgcgatgctactgatcctgtatttattgttttgcatgcgaacgtatttgcggcagcttttccggcacggcagcctgttcagaaaagtgtttgcgggagcgctggccgcagccgggatttggtggatgctcagtttctctataagtgaactgctgtttctgattatcctggctgccattcagcaaatcggatcatttatttataaacgattctcttatcgcagcaccgcttctcttgatctataaaatagctacatcgcaatcgcagacggacccgcgccaaccggaatcaccgtcacggctgtataatcacttgtgcggtacacggtcacagcattgtcgttgggctgtgccgcataaatatactgtttgtccggcgttacggcgaggtcaaaggcgccggggagagacacgtttgcaatgatcctctgtctggccgtattaactacatataagttattaatgagaaacggttcactatatggctctagaaaataagctctagtactatcgagagaaaatacaatcgtcatcagcgtttcaaataaacggctgaagtcccctcccctgcttaatggagacaaactaatctccgttacacctttcggccacaactcaccattcaacacgtacgcaaaatttccagcgtaaggagttgcaattaaactgggaaattcaaatgaatctatgatactttctaccaactgcccagtatttacatcatatttatcaaccgaccaactgcttccattagcggtatagacatactgtccattcggatcaagagcaaagtctaaagcgccgggtatcggaatgacatcaatgaccgattgagaggccgtgttaatcacatatatagatccggcggccatcacgtatgcgaactcatctgttggatcaaattcgatctttctcggccctcctccaacagtaatggtatttatgatggttaatgttttattatcaatcaccgagacaaggttggtatttccatggaggacatacgtgaatgctttatcgaaagtaacgcctagattagttggcacgtcagaaaaagggattgtttttacaacagtgtttaaatctgcatcaatgaccgaaaccgtgctgtctccagtattggcagtaaacacatacgattgagggtctggcgatggcggtaaaacaagtgtcccggtcaccgtaagcggactgccgtagaaaggcggtacaatgagaagatcttccactgtcatttgactgaaatcaggacagcggtcagactgtgctgcataataaacaacttgatcaatctcttcggtatgaatcacagaaacagccccgtctccttgtccatattgatttcgtacaggcgacacactgacaagaagcgtaatggtcccttgtactctcacggcatatcgaacaccgatatcttctggttccggcccagtctggattaagcaaggctcactgatacaggacaaattgtctgtactccatgtaacagccgctgacgcttctgccgaatcaaccttgaagccctcagggatatctatcggcacttgaaacggcgcttcccggctaatttcctcatcacaaaaacagaaacaattttcctgtaaagcagaaagatcattctttttcatgatttcacgtccttttagaaatgcacaacatgcagcggttaaatcgtaatggcacccggtgaaacccaagagatatcacagtttcctcagaataatcatctgtgttgtaaacaatgatgctctgctctataaaacgagttgcatacagaaaatcgccattcggggtaaacgcatagtctgttgctgattgcggaagatttccaattacacctgctccattcggactgacagaatataaattgccagtgaagctgtcatgtaaatacacctctgatccactcgtaaacattacatatagcccgtcaggctccagctcttgggtatccttgatcgtaaacgtatttaaatcaataaccgtcaaataattgaataagaattcttgttctaatacatacgcataccgctccgtagaatctgtttctatggatgatacgataagctctcgttcaattgttcctgtgacttcaccggtagataagtccactttttgcactaacccaaaattaagaacataggcgaacaacccattggggtcaattgcaatatcaaaaccttctacaggaatagacctctcaacagtcaacgtatcaattccaatcacataaatggcagtgccggcgaaaacataagcaaattcatgattagggataaatgtaatcgattgaggctgctgatccagcaaaataaatgctgccaccgttaaagtgtcataatcgatgacagaaatcacattattgttgaaatgcaagacaaacacagcgcttttatccggagttatttcaatacctgtcggccggtacggaagagcaatcgttgtcacaacagtatgggtgtttgtatcaatcacagaaactgattgatcatttggattcgctgtaaacgcgtagacgggttccggctccggtacaagcacaatcgtccctgtcaccgataaaggactgccgtaaaacggcggaacaacaacaaggttctcaatcgtgatgtcactgatatccgggcaatcatccggttcatcggaataatagacgacttgatcgatttctgcattgtgaatgacggaaacagccccgtccccttgtccatattgatttcgcacaggtgagacactgacgagtagcgtaacggttccctgcaggcgcactgcaaattgaacaccgacctcatcaggctctggccccgtttgaattaagcaacggtcactgacacaagaaaggctgtctgcattccacgtcacgtttgcaacagcttcagccggatcaacgacaaatccttcaggtaattcaatcggcgcttgaaacatggcttctcggcttgcttctccctcacaaaaacataagcactcttcttgttctgctcctgctttttctttaaaggaaagcttattttttctcattccttcacttccttttcagacatacactgctcacgcagatataacagaatatggaagagtaacgtgtttgcttgtacaaattgctgagggtaaacgcttctttttgaaaagatatctccaaacatgcggtgtaacgaaagaaaaaattgcggtttttttgcgcttctcacaagaatgttgatgataaaatatgacatatatagaattatgaagggagggatttgcaaacgtgacaggtgtcatatcttcttcttccatcggagaaaagattaacgaatggtatatgtacatacgccgattcagcatacccgatgcagagtatttgcgaagagaaatcaaacaagagctggatcaaatggaagaagatcaggatcttcatttgtactattcactgatggagtttcggcacaacctaatgcttgagtaccttgaaccgttagaaaaaatgaggattgaggaacagccgagactgtctgatctgctgcttgagattgataaaaaacaggctcgtttaactggtctgcttgagtactattttaatttcttcagaggcatgtatgagctggaccagcgggaatatctgtcggctattaaatttttcaaaaaggccgaaagcaagctgatattcgttaaggatcggatagagaaagctgagtttttctttaagttgtctgaatcttattactatatgaaacaaacgtatttttcaatggactatgcacggcaagcatatgaaatatacaaagaacatgaagcttataatataagattgctgcagtgtcattctttatttgccaccaattttttagatttaaaacagtatgaggatgccatctcacattttcaaaaagcttattctatggcagaagctgaaaagcagccccaattaatggggagaactttgtacaatatcgggctttgtaaaaacagccaaagccaatatgaggatgccataccttatttcaaaagagcaatagctgtttttgaagaatcaaatattcttccttccttacctcaagcgtattttttaattacacagatccattataaattaggaaaaatggataaagctcatgaatatcatagtaagggaatggcttattcacaaaaggccgaagatgtaatatatttatcagagtttgaatttttgaaatctttatacttatcaggcccggatgaagaagcaattcaaggattttttgattttctcgaaagtaaaatgttgtatgctgatcttgaagatttcgctattgatgtggcaaaatattatcatgaacgtaaaaattttcaaaaagcttctgcttattttttgaaggtggaacaagtaaggcaacttattcaaggaggagtgagtttgtatgaaattgaagtctaaactattactctcttgtctggctctaagcactgtgttcgtggcaacaactattgcaaatgcacctacacaccaaattgaagttgcacaacgaggaatgatttaatgaatacaaccggttttcaccggttgtttttttgttaaataaacaatcgggacaaaagttttattttttgaatctctaaatattattactaactaattcaaattggttacctaacccacaaacataggaaacaagataatttttattatacgaaaataaaaatatgtttacttttccttttttttgaactaatatatatatgacttaagttcagtatcacttcaattgaagtttaaaaatggaggatttattttgaaagttcaattcaaaaaaaggattagtttactcatcatcatgtttgggatcgcagtttcctcactgggtgttacacaggcggttcatgcaaaagcaaatacgagcgattcaagggtgcattttactttcagatggtacagcccttacgactatacaactgctcgaagaaaacaaaatagaagctacatgtatatgcatctcctaaagaaagatgatggaggtaaatttaatgtatgggcagaggcagataaaaacgttcactctggcgggcgcgactggcacaatgtatccggtggtggaactcacgaaggaacagtacacccgggtcatacatacttattttccaacactgctgttgaagattacgggagaaatgtacccgtaaggtttggcggttacagccgcagcagtgattccttctcaactgattggagtcctgacagcgtaaaacctaagggaaattacacaatctattaatagctttctcaaaacaaagcgatcttacattaaacatgtaagatcgctttttaaggtaaaaataatatccactcttcaagattgtttattaaaataaaactatccaaaactcacacagagttttaataaaaaaacaggagcctcgcacatgatttctttctttttaaagcgtttattgaaaaataaagagatttatttttctttattcattagtatcgttcttatgatcgtcagttatctaggtatactcttctttcatcagaagatcaatcttccttatgaaatccataactcaccgtttttatcgaatattgcagaaggaaatacaacctcagctcagactgtctggattctcattcttccgttattagcatcacttccaatgtccggtatgtaccgtgaagataaaaatactggattttttatgaatgttataacaaaaacaactaaaaagaaatactttacagtattattcggattgaatgttgtgatttcttttttggttatttttttaccgttattattaaacctttacttgctgatgatgacatatccttcagtaaatccggacggaatcgtcaattatatggacccaatcgttttgggcggaactgatttagcaaacctttattatgaaaactcgctgatttatactctcattttatttatactaaatggtttgtacggtgccattctctcttccattggattagctttatcattttttattaaaaagaaatattttgtttatatcatacctttcttaattaatttgataggctttactttactcaacaaccattacaatccaatgaaatatattgttaacgatggagggtttttgagtgtagataagtttatttatttgaaccttagcgtgttcattgtaactactttactttatatgtggggaaaaaaacgccgtgttttattataatactctaaaatcaacattaagaatgaagtggccgggtatcaccgtcgcattactgctgcagttaattgctgtttatttcttttttcatcaagaaaatggtagtgatgatagttttgtactggaaaatattttttcctattggcatctcgtttctattttatgccctgctgccgttgtattttctgttttgatctcatccgattacttttcaatttatactgtaatccgagtaaacaatgcaccttatctaacaatgatataccttttaaaaacacttttattttcagcagtatacgggattatcattatgggtgaattatatactttatgtgtattcaatgatacgggactattgtatatgaccccgatatctttcatcactcatgtctttgcatttattttcatttgttatgttgtttcatttattttactgtatttgaatcaaatcattgtagtttttctattcattcttttatttttaattgattaccttgcatgtaatggtatgctctttttaaatggttttgtactggaattaagtgattcggctgaattattattgattagattagggattatgttgttattattcgggatttctatagaatctataaagcgacgcaattatttacagcaggttgaggagaaaggagcaaactgattgtcttttatgaatatgctgaaacgtgatattgtcatgcgtttcaatgaaagtaagattacatactttgtcattagcttagctgttgccctccttcttttatgcttcctctggaatagcaataagacgggacagctagaacatcaaagttttttcgacagcctgaccacactatttcattcgatgaatttctttgatctacatatcttatatacacagcatagattatctatccctctacaatggattagttttcaagtgctgcctttgttgattgtgggtaattttatgtttagtgatattcaaatttctggagcttatatccttccaaaactccccaaaaaaggagtatatatattcagcaaacttctgtcactgtttgttctgattgtatctatttggtgtgtatggctttttatatacattatgttatttacctcatttaatggctttacagcagaactgaacagcaaggtaatattatttatgttaattcaaatcttagtttcgtttatgtatgcagttttgctagaaactttaactttcatgatatcttttatatcagcatttattattattgttgcttatattgtaatatctattttttttcacagctctttattcatcgcttcatttgctatggctggaaagtgggcttttattgattattcgcgcatgaacattaactactcagatggtcgtttttttcatgcctctgactttttattgattgcacttattttctgtgcagcttgtacttttatcagcctagtttttattaaaaaaacagatattttaggagagtaattatgacgtcgtatatcgagtgtaaaaatatagtaaaaaaattaaagggaaatcatgtattagatgatatcagtttttcaattaaagaaaacgaatttgtcgtgttaagaggccataatggatctggaaagacaatgattttaagagccatcgccggactgctaacattaacaaaaggcgaagtttctgttaacggcctcgtgatcggaaaagatattgacttctctgaacatacaggtctgttaattgaatacccgagcttcatccctgtctattcgggatttcaaaatctgaaattccttgcttctatcaagaaaaaagtatctgatgaagaaatcaaagaagtaataagaaaagttgggttagaccccgaagataagcgtaaagtcaaacgctattctttagggatgaagcaacgcttaggaattgctcaagcaataatggaaaaacccaaattacttcttttagatgaaccgacaaatgccttagacaaaaaagggattaatcttatactggatatcctaaaaaccgaaaaagaaaacggcacaacgattgtagtggctagtcatgatgatacactatgtgaaaatagtgttgtcgacagaattattgatattagtgaaggtaaactggaggatacagatgaataaacgttggattttctttattgttttattaataatagtaacattcagctgtgttcgtttctatacagtgaatgcccaaaatgataaatatactccaaaaaatattaatattgccgcaaaccaaacaatcgatacaggaaaaggaataaaattccatattttaaaaccattaaagccggtcaagtcatttgataaagatacaaattccataaaatatatatacattttgccttttaatgctgaaaatacttctaatcataaaattactctagaagatctttcaccggacggaaaaaactttttattttttggtcagtatcaatataataaacaattgatgccttataattatgatttgccggataagtatcaattcaatacagagattccaccagggaaaacagtactaggatatgtaggattaagtttgtatcccgacgaaaaagtaaattataaaaatttcaatcctgaatcatcaaaagtatctgcttattatactgtaatagacgacgaatctaataaaagaatttcttataaaatgactttaaataattaaaagataaaaaagggcctggatgtaattcagacccttttttattaaaaactatttcacaaacccaagcagcatttcacggatgattttgctggctgtgtttgccgtttgctctgagtggtcatacaccggtgcgacttccactaaatcagcgccctttacgtttacctctgaacgcgcaatttcatggacggatgcaagcagttctttagacgtgatgccgccggcgtcaaccgttcctgtacccggtgcgtgtgcagggtctaatacgtcaatgtcaattgtgacataaaccggacggcccgccagcttcggaagcacctctttcagcggttcaagcacttcaaattttgagatgtgcatgccgttttccttcgcccattcaaactcttctttcatgccggaacggattccgaatgaatacacattgtgcggtccgatcaattctgccgccttacggatcggcgtggagtgagaaagcggttctccctcataatcaacacgaagatctgtatgtgcgtcaaaatggataatcgcaaggtctgggtatttcttgtacatcgctttaatgacaggccatgacacgaggtgctctcccccatacccattgggaacttccctttttctaaaatgctatccacgtactcctcaatcatatccaggcttcgctgcggatttccgaacggcagcggaatgtcgccggcgtcaaagaagttcaagtcagccagatcgcggtctaaatatgggctgtattcctcaaggccgattgacacctcacggattctgcttggaccaaagcgtgagcccgggcgatagctgactgtccagtccatcggcatgccgtaaagaatggcgtccgcctcttcccactcgggacggctcgcgataaatacttttcctgaataagcttcatcaaatctcatctataataccctcgctttcctgtaaaaaagcgcaagattcgctcctgcgccataccttcattatttaatcaggtcactcacaaatttcggcagaacaaacgccgctttatgaatatcttttgtgtaatatttcgtctcaatatcgaagaaacggctgtcttccactgcaagcggatcatattttttcgagccaattgtaaatgtccacaaaccgctcggatatgtcggaatgttcgccgtatacagcttcgtaatcgggaagatttccttcacgtcgcgctgtacatttgtgattaattccggtgtaaaccatgggttgtccgtctgcgcaacgaaaataccgtcttctttcagcgcttttgcgattcctgcgtagaatccttttgtaaacaggtttacagccggtccgactggttcagtcgaatctaccatgatgacgtcatattgattttcagattttgcaatgtgcataaatccgtcatctacctgcacgtcaacgcgcggatcatccagtttgcctgcgatagaaggaaggaactttttagagtattcgataaccttgccgtcaatatctacaagtgtcgcttttttcacgcttgggtgcttcaggatttctctgataacgccgccgtcaccaccgccgactacgagaacgtgctccggatttgggtgcgtgaataatgggacatgcgccaccatttcgtgataaacgaattcgtctttttcagatgtcatcaccatgccgtccaaaaaaagcatgttgccgaactcttctgtttccaccatttctaaatgctgaaactccgtttgttctgtatgtaacgtcttgttaaccttcatcgtaatgccaaagtttttcgtctgcttctctgtgtaccaaagttcgctcaattgtcatctccctttcgaggctgtattcatttattgtaagcgtcttatcagcttttattctcggttgaaatctcattttcacctaaggaaaaagtatagaggatggcggggaaaaagtaaagatgcgtcctgttctgcgatgtttaaaaacgatctttttttctcataatagtagaaacataaaaaaagggggaacccgttgtggatgcaatgacaaataaacggctgagactgacgctgaaaaccgttcgcgcctttatctttttaggggcttttgcggccttggcggcagctgccgtgtttatgactgtcattttgatagccaaataccagggcgctccctcggtgcaagtgccgcaatccacgattttgtatgcgagtgacggctcaaagctcggggaaacgaactacggcgaaaagcgctattggatccccttaaaggacatgaatccgacgatcgtaaaagcgacagtggcgattgaagaccaaaatttctacgatcatcacggctttgattataaacgcatggccggcgcggcgcttgctgacctgaaagcatttgccaaggttcagggtgcaagcaccatcacccagcaatatgcgagaaacttataccttgaacacgacaaaacgtggaaacggaaatggaatgaggcgttctatacgatccgtctggaacaaaactattctaaggacgagatattagaaggctatttaaatacgatttactacggacacggcgcctacggcattgaagcagcttcccgcctgtatttcggcaagcatgccaaaaacctgacggatgcggaggcggcgcttttggcaggtatcccgaaaggcccttccggctattcaccgtatgtcaatgagacgaaggccaaggaacgccagaaaacgattgtgcggatgatggaaaagcagcagatgatgagccaaaagaaagcggatgaattgatcaaggaacctctttcctatcagcctttgaataaacaagtttccaagagaaaggctccttatttctacgacaatgcgatgagagagctggagaaaaagctcggcatgacacgggagcaaattgaaacgagcgggttaaacgtctatacaacggtagataaacggatgcagcgcatcgccgaggagaccattaccgaaacggttaacgcgggctctgacattcaagtcgggttttcagccattgatccccgcaccggaaacgttctcgcccttgtcggcggcagggattatcaaaaaagcccgtttgaccggacgacacaggcgaagcgccagcctgcttcgacgatcaagccgttgctgtactataaagcgattcagagcggatttacgccagtcactttgatgaaaagcgaagaaaccgagtttcaaattgatgcaaagggagaaacctattctccaagcaactataacggatactatgccaacaagccgattacgcttctgcaggcgctggcgctttccgacaatatttacgctgtgaaaacgcatctttttctcggcacgaacaaacttgtaaagacggcaaaggaattcggcattaccgcccatcttcaagcactgccgtccctggcactcggcaccgaacccgtacgtccgattgagatggtcaacgcctatgccatgctcgcaaatggcggaaagaaaatcgaaccgacttttatttcaagagtaacggacgcagccggccacgtgctgtacgaaaacccgaatcagcataaacaggtgcttgatgaaaaagccgcttttgtcacagcgagtatgatgacaggcatgtttgataccgatttaaatggatatacgtcggttacggggcgaacgatagccaaccgcctgacaagaacgtatgccggaaaatcaggaaccaccagcgcagacagctggatgatcggcttcaatccgaagctggccgccggtgtttggaccggctatgacaaaaacagcaccatcgactcggtcgaagaaaaaagctatgctaaaaccatttgggcggacttcatggaggacgcgctcaaaggcgaaccggaaaccgcgttcaagccgccaaaaggcgtaaccggtgtgtacattgatccggaaacaggctactcatcaggtcccggctgcgccgctaagcattacacatattttgtgaaagggacagaacccgcaaacgtgtgctacggggcagaacccgcaaaacaaacaaaagaccggcttccatccaaagaaaagcccgcttccgagaaaaagtggtgggacaaatggctggggcgacatcattgaaaataacccggctcctcggaggccgggttattcgtatggttggtcaatgacccatggaagaagcgtaacacaatcgagctgaataattggttttggaaaacccttaggaatgtaaatttggtgttgcggcactgaaaatgaaatatgccacgagaaatcaatctttttcggattccattcttgttttccttcaacaatacggcctactataaaataactcgctatataaaagtgcagatgatcttttaccccatgataatttatatctgtgcatttggacggaatgaggccgaaactttctaatacttgtgctttttggactggcagttcattcactgcctcgtaatagttaagacagttaccgcattcacacatatcctctatatctttctcatattgctttctcgtttcttccacgtcggcttttatcaaccaatcgccgactcgaatggtttcgtacatcatatccccctaaaaatgaaaaaccccgagtcttgtttcggctcgggattttccatgtcctatttctgtatcaccagtttactcaatgtttacgaaaaatatctcaaatactttaaaagttcacagaaaattcataaattaattgttttccggaagcaggctcgtttttaactcatctgaggaacgatcccataggccctgatcatgctttttcagaaattcgcctagtacacgcttcgagctgtcgtccattttatcaacgatgattttccgtttcatggatttatccatcaaattcacatgctcaggcagcgacttgtagcctcttctgatgcttctgtcgaccgtcatttcacaggctgtcacaccagcgtaataaggcccctcttcttttctgtcaatcgttacccacacaagccagtatggttttccgttcggcacttcttctttattcgggagaaatttaattcctttttcaacggtgctgcgggcatgcatggcgccgatgtctacgaacgcttctttttcttctacatcaacgaatacgggagaaatgttatcaaggctgagtgcccctacgccaaaaccgccgtgtccgtctgtcggatcacttttgataatattaaacccgattgattttttctttttttcttccatgaagttctacctcctacaaaagcggttgaaatatcgctgaaaacagctttaaaatcgaatctcttcctgcattgagcatcggccacagcacgtaagatcctagcggtgtcacaaacagcaccaaaaatacgataaagccgtagctctccgcctgcgtcattttggcacgcacgcccggcggaacgagatcttctataattcgatagccatcgagcggaggaagcggcagcagattaaataaaaacaagacaagattcagctgtatccaaatagaaaaaaactgatccagccccgtgctgaacgccgcaagcatttccattccgtacgcatgcatcaacactaacaaaaagaaaccaataaacgcaagaatcaggttactgacgggcccggctatagatacgagcacaccggcaagccgaggcttcttaaagaagcggcgattcacgggaatggggcgcgcccacccgaagccggccaccaaaatcaaaatggttccgaacggatcaaggtgtttaatgggattcagcgtcagtcttccttgttttttcgccgtatcgtcaccgaatttgtatgcgacataagcgtgggcaagctcgtgcatcgtaaacgacacaattagcgtgatgacgaggtatggcattaaagataacggataatataaaaaacggtccaagtgagatatccctctttctcaaaatgcaagaatttactttattcagtatactataagaagcctctttttctaaagagaggaaacgagataaaggaggattcagcacccatgccatacgtaactgtcaaaatgctcgaaggccgtacagacgagcaaaaacgcaatcttgtcgagaaagtaacagaagccgtaaaggaaacaaccggtgcttctgaagaaaaaattgttgtctttatagaagaaatgagaaaagaccattatgccgtcgcaggcaaacgcctgagcgatatggaataatctctataaagccggcgcttcgcgcaccggcttttattatccctattgagccagcttcgcaataatcgccaagaacgtctttttctcttcggctgttaaacgttcaaacatgccgtcaatcagctgctggcggttttcgatcatttgttcagccgctccccggcccgattcagaaagcgtaatccatacagtgcggcggtcattattatttctggatctctcaataaacccttcctgctctaaatgattcagagctgtggtcgtggcagagggagacagtgtgacctcctttaaaatatcctttatggtgcagctcccatgtctgtatatgatccgcagaataaaccctcttacattattcacgtgtttcggaacggtggcttcatctaattgcttcgtgcttttcaaatattttgtaagtgcgtgatccagcaaatttgcttccagtttgtcatggtccatgtaaatttccccatttcgagatgcattcataacatacgaacgatatgatttacttattattttactgattccgaatagggaaagtcaaaaaagcaaaatatgaattcacagcttttatcctacatgcctcgattttccacctgtttcacaagctcatctttaaatgtctgaaaaggaacgtgttcattctgctgatatccgaattggcggacgtttaccgcatcctcctgctcctcatgatctccaagcaccagcacgtacgggattttctgcacctgcgattctctgattttatagcccagcttctcattgcgctcatcaatgccggctcttatccccacctgcttcagctccgcctgcacctttctgcaatagtctaagtgaacgtgcgaaaccggtatgatttgaacctggagcggtgcgagccagactggaaaagccccgccgtaatgctcgatcaaaatgccgaaaaaacggtcgattgagccgaaaaccgctctgtggatgacaacgggacgaaccttctcattgagttcgttgatatatgttaaatcaaatttttccggcatttgaaaatcaagctgaattgtcgcgcattggtggctgcgtttcaaggcatcttttatgtggaaatcaattttcggcccgtaaaacgctccatcaccttgattgatctcataagagaggccaagctcctcaaggacgcgtgctaaggcacgttccgacgcttcccaaaggctgtcatcgcccaatgaatcctccgggcgagtcgaaagctcaactgaatactcgaaaccaaatgtccgatatacctcatcaatcagccgaatcgcttctttgatctcactctcaatctgatcctcccgaacgaaaatatgggcgtcatcctgacagaacgtccgaacgcgaagcattccgtttaaagcgccgctgtattcatggcggtgcacctgtccgaattccgccatgcgaatcggcagatcccgataagaatacaggctgtttttaaagatgagcatgtggccggggcaattcatcggcttcattgcgaatcttgtatcatccacttctgaaaagtacatattgtcgcgataatggtcccaatggcctgactgctcccataaccgctgattcatcataaacggcgtacgcacctcatcgtagccggcatttgtttgcagctcacgcgagaagcgctccagctcattgcggacaatctgccctttcggcaaataaaacggcatccccggcgcttcttcagaaaacataaacagccctaactgtttgccgagcttgcgatggtctcgttttgccgcttcttccagcatatgcaggtgcgcatccaaatcttttttcttttgaaaggcaaccccgtacacccgctgcaggacttcatttttgctgtctccgcgccaataagcgcctgatactcttgtcagtttgaacgccttgatcatccctgtagaaggaagatgcggccctcggcacaggtcaacgaattccccttgctggtacagtgtgatatcctcccgcgcggaatatcctttaaaatctcaagcttgagccgctcgtctttttgtgcaaacagctcttcagcttcttcgtaagaaacctctatacgtttgatttcaaggttctcatttattatgtttttcatttctttttcgatggcctctaagtctcctgatgccaagcttttccccagcttcatgtcatagtagaagccgtctaaaatcacaggccctacccccaatgacacttcgccgtacagccgttttactgcttgggccagcacgtgcgctgttgtgtggcgaagcacctgcaagccttcttgtgaatcgagtgtgacaatcgaaagctcagcatcctcctccagcttgaaactgagatcaacaagcttgccgttgacctgacctgcggccgctttcttttgcagactggaactgatagaaccagccgcttctttgattgtgatgcctttcggatattcctggatctgtccgtccggaagctgaatgtgtacatgtttactcattttagaacactccttattcattgttgtatataaaaaaacacacccgtcccgcagatagggacgagtgtgtgattaacccgtggttccacccaagttcccgacaaatactatgttgtcggctcggtgctgtaacgcagcatagacggcattggttacttcagttccccaatgctgctccaaggcggtaaatgatattcctaagctgggaagctctcacctttccttccctctctgaaaaccgtaactatcattcatgtccttttcttcgcatgtattcaattcataaaaaaacacacccgtcccacagatagggacgagtgtgtgattaacccgtggttccacccaagttcccgacaaatactatgttgtcggctcggtgctgtaacgcagcatagacggcattggttacttcagttccccaatgctgctccaaggtggtaaatgatattcctaagctgggaagctctcacctttccttccctctctgaaaaccgtaactatcattcatgtccttttcttcgcatgtattcaattcaaataaaaaaacacacccatccctctaaaagggacgaatgtgttgatcatccgtggttccacccaaattcccgatcaattacacatggtgatcggcttaaagatgctgtaacgcagcatgacggtatcagatacttgttttccccgatacggctcaaaggcggtaagctgctttccctgcgttaggaagatctcagctgtccttccctctctggaaaccgtaaaaagcatctcgtgtccttatcagtgcctgttgtttcaataattttttatatcttactatatattcccacaaagcgcaatcagtgatttacattttttctgacgcggcagtcccgttatgggcagccagaaacagccatacaagtaatgcagcgaggctgtatgccgctcccatcatcaaaaacgtaaacccggcaccagcataccaagtggcggacagatgaatgatcaccccggttatcgctacgccgaccaaggctccgatttgccggtttgcatttaacgccgcaccggcgatattcgcatgtctttgcccggcagcctgcatgatcacagttgtcatggcaggaactgtaataccggtacagaggttcataacagacatcaacaccgccagctgccaataaggaaaatccggagaaatcagcacaaacaacagcaatgcaatgatacagctgaccgacattgatacaaacataagctgaccggcttcaaaccgattcgccagacgggcaaacagcagattgccgatcacgaagaccgccatcatcggcagcagctccactccagccataaaggaacttgcgcctcctgcttcctgcaaaaaaaggctgagcataaacatgccgccaaaaagggtgaaattcagcaaaaacccgataaattgggctgctgagaagcggccgtttttgtataaggacgccggcaggatgggtgcttttgcagaaatttctcgcagcaaaaacagcacaaatgccaaaatcgttgcagtaaatgctgcaagaatcactggcgagcgccagcccgctgaaggcccctgtatcaaagcataggaaagaaacccgagagccatcatgccaagcagatgcccgatgatgttcacgcggctgctttttcccggaacgtggctgaggattcggtaagctgaaatgagcgcagcagcccctattggcacattgatcagaaaaatactctgccagcccgccaactctaccagcacgcccccgataaaaggcccaagggctgaagcggcggaaacaagcgcggcccacagtccaaacattctcgcccgcacccgctcatcagggtaagaggcagccaaaaggctgagtgagcttggcataaacaaagctgctccaattccctgtatgagacgtccggcaatcagcatctgcccatttatagatgcagcgcatagacaggaggccagaacaaaaacagctagacccaagatatagatcgtcttcgagccgaaacggtcagccaaggctccgcccgccagcagaagcgacgcaaaagtaagaatgtacccgtccacaacccacgttacacctgaaagtgacattgaaagagtgtttttcatatcagccatcgccacattcacaacggtcacatcaagagttgccatgaggaaaccaagtgcgagcacgatcagcacggatatgcctgttgatgatgttgattcttgtatagacccgctatttttcattacaattgccctttcacttgcttgattacccaatcatctattttttcaagatcatacaattccccgactctgtccatgacatgctgcaaggattcttctctcataagattggaccatttatcctcgatttccccatgactgtctccagcacacagtgactttcaccctcaaatacagattgcagcaggcctttcccctgatacatcgaacctctgccttcgaccgcttgataaacatcataaagcgtaatgtcagccaaaggcttcgtcagggtaaaaccgcccttcgtccctggtaaggattctgccaaaccggcttgaactaatgttctcatcagcttcttcaagtaagacggagacacacgcaatcgctggcttatagcctctgacgtcaaagaagcctgtaccggcagccgtgacagtaacagcagcacagaaaccgcctgctccattcctgatttcattttcatcctattcactcctgattcattatagataactattatccataatgaatctcttagcagcttttgtcaataaaaaaagcaaaagaaacgattcatttcttttgcttggtatggttaacaaatctgcttcagttcctctatgtattgaagcgcttcgtcatattcttcatttgtatatttttgcttgcttttgatggtaaagactttttctttcttttcctcatcctcaagcccgtcaaagtaaaggatcgtggaaaccagctctaaaaaccgtgatgaacggctgtttacactgtcgatatagcctttcatatccggcatgtccagatcagcatggtctaaaaatgcggagcctgtctcagtcagagaataccggtattgaaagtagccgccctttttttccttcacctcatgcagaaatccaaggttgcacagctcttcaatctggagcgtcagttcctctgaatatggtccgtaaaagtgaaaatcatatttctcatagaaaggaaactgcattttcttggcgatataaatcattttctgcagcttctttcgcccgatgatttctccagaatccgagaacaccttcatcagttttgcatgttctttcaacaaattcccgacatctcctttttccttctttccaatttctatgtcagtcccagcagctgccggattttcattttcgcttccggatgtttagagccgtcacaaatcaagtcctttggatagtacagcttgtggtccgtccgccgtttacctgagatggattccacaatagccgactgcctggacagctctttaatttggccgttttgcgtcaagagatggatcggcagacgctcctcttcctctcccggtcggtaaaaatcgtatggcagatctgatgaagaatcaacgaccaaataatagctcggatcgatccccgcctctttgaacaatgaagtcagctcaaaataagccgacatttcttcattaggattgaattcaacgtattggaaaagctggcggttaatgaatctgcggcacaagtcggataaaatcacgtcttcttcatcctcccaggcctggaagtaatacaaaataatagattcatccagctttacataatcctccagtgtcaatttcccttcaaaaatagaatagaaatgaaccggagcgtgagtgaagacatagccttcatcgtgcagctgcttcgccctgtgaagaatcttcgttaaaatgacctctgcacttctggtcacaggatggaagtagacctgccagtacatttggtaacggctcatgatatagtcttcgacagcgtgcattccgctttctttaatgacgatctgatcctcgcgcggccgcatcacccgaagaatccgctccatatcaaaatggccgtagctgacgcccgtataatatgcgtcgcgctggaggtaatccatgcggtctgcgtcaatctgactcgaaatcaggctgaccacttgcttgtttttatatgttttggcaatgacttcagcaacatcctgagggaaacccgggctcacctttctgagcacctgattaacctccgtgtctcccaaaatgatacctcttgtaaaatcctcgtggtcaaggtgaaagaccttttcaaatgaatgcgagaacggcccgtgcccgaggtcatgaagcagcgccgcagccaaacagagttcgcgctcactgtcatcccattcagggcggcctttaaagacgtcatcaaccattcttctgacaatttcatagacaccgagagaatggttgaaccggctgtgctcagccccatggaacgtcaaataggtcgttccgagctgcttaattctgcggagacgctgaaattcacgggttccgattaaatcccatatcagcttgtcccgaacatgaacatagcggtgcaccggatctttaaacactttttcttctgataattttccatttggatacgccatcgtcattccctcttttttttagccgtgtttctattatatcgactctattctttgaaaacatccttgaatttgcccggcgatttgttccatcttcatgaaaaacacatcttgtgaagcaaaaaagcctgacctgagggccgaggctaagaaaaaatatgtttttacttttttattttcttttttactttgtcaatcagctcatcctctgtcggagctgacagcgggcgattgttcacaaaagcaaatgattttttccgtccgggcccgcaataagattggcatcctacctcaacctttgcgtccgggtccacttctttcaaacgcggcagcaatgttttgatattagtggcttggcaatcatcacacactcgaaattcattagccatgacgtacgcttcccttcatttctatgttcatctatgtgaataacctaaaatcacgtttcaaaaaaaaatcacatcactcttcattttacaaggattcgactgttcctgcaagccgctccatccttcgtatctcctattctttcagccaatttgtataaatattttccaacctggacattctaataccatgaatagaaaaatgggagttgagataaatgacaaaacagcgacaagacgcttggtcagaggaaaacgatctgcttttagccgaaacagtgcttcggcatgtgagggagggcagcactcagctgaacgcctttgaagaagtcggcgataaattaaaccggacatccgcagcctgcggattcagatggaacgcagtggtccgccatcaatatgaaaaagcgctccagcttgcgaagaaacaacgaaaacagcggatgagagcgctcggaaacgggcagcccgcgaaaaaaagattattatatcagcctcctgccgttgatcctgaaatcattaaagaaaccgctgcagaagagccggttaaaatggaaacaccatctgtcgaaaatgagcaacctttaatgtctggcgaacatatgccttttgttgatgaaagctttaaggaagagttagctagtctatcacacttattgtctcctcaaacgcctgcagctgcgcctgagatgacgatgaatgatgtgatccgcttcctgcagaattacgaaggcaataacgagcaatcatcagcattaaaaatggaaaacgagcgtttaaagaaagaaaatcaggaattgcaaaacaaaacagagcagctagaggcagaagttcaaaagcttgaaaaagaccaaaaaacgatccaagaagattatgaaaccttggtgaaaattatgaacagagccagaaagctagttttatttgaagaagatgaacatgcctctccgtccttcaaaatggaccggaacggcaatttagaaaaattagcggaatgacatagaaaaatcccaaaacgggcagctgttttgggattttcgccatgtacaaaatcctcttttctattgagaaaagagaatttcctcattttgcagccggatcagctattcttgtaaaatgaggccaagcttatgtgaatctattaagacatgtgagctgcctcggccgttttttgtttccgaggcgcagcagaaatgaccaaaagccccagcatcataagcgcaatgcccagccacgaggaaggcgaaagcatttcccctatgaaaaacacaccaagcaatgaagccgtcagcggttcagctaaagacagcgtgaccgccgccgaggccggaaccccggtaagccctttcgcaaacaaaaagtatgcggcacatgttgcaattaacccgatgtaaaggcttgttcccagtcctctaggggtccatatccacgagatatctgactgccataatagcggcgtcagcaagatggcgctgatcatgaatacaacggcggaggtcgctcgcggaggctgggttttcatcatcgctttactgatgagcgtatagcctgcaaaagaagcacccgctccaagcgccataagaacaccagccacatcaatccgaacattggaactgtcggaaaacagaagccagcaacccgctaaagccagcacagtcgcaatccaccaagagtttcgcgggcgtttcttcaatacggcccattcgagggtcccagcaatgataggcgcactgccgatggcaatcacagttcccactgcaattcccgtttctttaaccgctgtgaaaaacagcggctggtaacacgccatacaaacagcggctaaaaatacgagcggccatgaccaatttttcacgtgaagctcccggctgatccaaaccgcaagcagcatggcgcttcctcctattaataacctgaacgccccaaatgccagcggtgtggcgctttctggagccaacgcctgaacggttcccgtagttccccagaaaaaagccgccatcaatacaaaaaggctgtaaatattccccttcatctgcctctcccctttaatatggatgctgatgtcattttatcgtttttctttttgtcgtggttatctgtatgtaagaaggatttatctgaaaataagattattggggtaaaatgccgcttgagataaaaaatgcatgccgtcatatacagccggcatgcgaagaacgttcacccaaatacctttgcattccgctcggccatccggatgaggtttttctcaaattccatttcctcatcaatggacagtccagctgaataaagatgggtgcttaacgcttttaattccgtcaataaagcgaacattaagtcttgtacggagatgtctttttgcagaagctcacttaaggacgccatcgtttccggacgtatttccggatagacgccttttttatcgttttgtttgtctttcagcgccgcttgatagaatcgtctgatcaagtcggccctttcactgccgcttttatccgcacagagataaatttgaacagcgactccgccgcgaacgcgtctctgagagatgccggcaaactttttgccatttatactgaggtcatagctgccgggacaataagacccttcaatttcataggcttcgatctttgcgttgtacggtctcagcattcgtctcatcagctcgaccatcgcttcatatcctttgtctatatcgatgcctttcttttcgtcctcgaatatgagagagatatttaaaacaccgtcatccaatacgacggcaagaccgccggaattgcgtacgatcacacggtatccttcgctctccagcaaggagatgccatcctgcaaaaacgggaggcgtgtatcctgtattccaaggacaattgtatcgtggtgcacccatgagcgcgctgtcgccggcgacacgccttttccgacggacatgcacagcgtatcatccattgcgaaggattgcttcgcatcaaataaagggccgagactggattggtcaatgactctccatttcggctgcatcagtaaatcaatcggttggtttgccatctatgtaaaaccctttcatgttaggcttattgaacgaaaactattatatcatttcagcagctgtgattgataattgcttttcagcatcgtaataaaaatttctttattttttgtattctccatgagaggagaatgaatgtaagacagcttgcgctttaacgagaaatctttaatatgcagaattgagatttcgcggtggatcaaatccttatgcagtacgcttctggatagaaccgaaagtcccatgccgttaatcaccgcttcctttacaccttgattgctgctgatagtgaacattgatttcggccgaagtccatttgaactgagtacatgatcgagatattctctcgtcccggagcctttctctcttgtcacccacgcttcgttctgcaaatcgctgatcgaaatctctttccgcccagccagcggatgctgatttggagcggcaatgcacatttcatcctccatgaacggttcaatttccagctcattctcgtttgtatgtccttcaatcagcccgatatcagcctgaagcatccgcacacgctcgctgacctcctctgtattgccaatcatgacatcgaggttcagctctggatacagcttttgcagctgggccaatagcggcggaagaatatactcaccgattgtaaagcttgcagctattttcaattcgcccttcacatagtgatgatgcgcatagatttcagccttggcttgttcgtagagaaacaccatttgctttgctctttgatataaaatgtctcctgtcggcgttgtcgtaaagtgttttggcgacctgttcagaagagccgtttgaaattctttctcaagatttttgatatgcagactgacgctgggctgggagatcatcagcttttccgccgcttttgtgaagtttttttcttctaccaccgctataaacgttttcagcacgtcgtaatacaaaaaccccacccctgtcattaatgaaatatatggttatgattagttttctttattgtactcatatcatccatcttggtaaagaaggctatacggaagcgcaaaaaaggcagccctcggtcgagagctgccatcgtcttcatttttattacagtgcttgcgccgctgtaattaatgcgagattgtaaacatcttcagcgttacatcctcttgaaaggtcgtttacaggcatatttaaaccttgcaggattggtcctaccgcttcaaagttgcccaaacgctgagcgattttatagccgatgtttcctgcttcaaggcttgggaatacgaatacgttagcgtcccctttgatctcggaatccggcgcttttttctcagctacagatggaacaaatgcagcatcgaattggaattcgccgtcaagtgtcagttcaggcgctttttctttcgcgattttcactgcatccgctactttttctgtttcatcagattttgctgagccttttgtagagaagctgagcattgccacgcgaggctcaatgtcaaacatttttgccgtattggcactttcgatcgcaatctcggcaagatcttggctgtcaggtgcaatgttgatcgcgcaatctgcgaatacgtattgctcttctccgcgagccatgatgaacacgcctgaagtctttttcacgccttcttttgttttgatgatttgaagagccgggcggacagtgtcagctgtcgagtgagcagctccgcttacaagtccgtctgcaaggcctttatacaccagcattgtaccgaagtagttctcgtctaataatgctttacgagcctgttcttctgtcgctttgcctttgcggcgttctacaaatgcttgtacaaggtcttccatgccttcatatgtatgaggatcataaatcttaacgccgtccagcgtaaggttcaattcttttgcttttgcttggatctcattttcattgccgatcacaatcggattcagcactttgtttcctgcaagcttgctgaccgcttctaaaatacgctcgtctaagccttcaggaaatacaattttaacgtcttttccagctactttttcttgcactgttgaaaataaatctgccacaataaaacctcctcaaaaagttacaaaaacgctttcttttactagcatactcttcttccaatcaaattcaaacagccaactttcattatagcgctttcataaaaaaatcttatttttctaactaatttaagtgactcaatcttcccttataggttcttctattttgatggagttatacggaagggatgttcaaggtttctccacagtagaatcggataaactatggtatagtgaaggcaatcatgaaaagataatgggagtgaatataaatgagtgaacagcaaatgacgaatgaagcggcaaaaacgcttgacggctggtatgcgcttcatgatttccgcacaatggattggacttcctggaagcttctgtccagtgatgagcgccaatctatcatacatgaattcaccgggttgcttgaaaaatggggcgtagcccaaaaagaaggaaaaggatcgcaaactctttacagcatcgtcggccaaaaagctgattttatgctgatgatccttcgtcctacaatggaagaattaaatcaaattgagcttgaattcaacaaatcaagacttgctgagttcaccattccggcatactcctacgtatcagtggtagagctgagcaactacttggcaagcggtgacggcgatccttatgaaaatccgcatgtgcgcgctcgcctttaccctgaactgccggaatctaaatatgtatgcttctatccaatggataaaagaagatcaggcaacgacaactggtatatgctttcaatggaagaacgcagaaacttgatgagaagccacggtttaatcggccgcagctatgcgggcaaagtcaaacagatcatcaccggctctgtcggctttgacgattacgagtggggcgttacattatttagcgatgatgtccttcaattcaagaagctagtgtatgaaatgcgttttgacgaagtcagcgctcgctatggcgaatttggttcattctttgtcggcaatcacctttcgcttgatacacttcctcaattcctatatgtataatatcccctcccgccctatccggcgggagtttttcaatcctcctttatcagaatttaaataaaatttgctattttcttcgttttttcttacgatgtagataataatccaattttttcaaaggggtgcagttatttgccaaaacgaaccgcatttgttatgggagccagtcaagggatcgggaaagcaatcgctctgaaattagcagaccagcatttttccctcgtcattaattcgcgaaatttggataatattgaatctgtcaaagaagacattttggccaagcatcctgaggcgagcgtcattgtccttgcgggcgatatgtctgaccagcatacgagagcaggcatttttcagaaaatcgaatctcaatgcggacggcttgatgttctgattaataatatcccgggcggcgcgcctgatacatttgataactgcaatatagacgatatgacggccacgttcactcaaaagaccgttgcctatattgacgctatcaagcgtgcttcctcactgatgaaacaaaacgagtttggcagaatcatcaacattgtcggaaatctgtggaaagaacccggcgccaacatgttcacaaacagtatgatgaatgccgctttaattaacgccagtaaaaatatttccatccagcttgctcctcacaacattactgtcaactgtctgaatcctggttttatcgctacagaccgttatcatcaatttgtggaaaatgtgatgaaaaagaacagcatatccaaacagaaagcagaggaacagattgcttccgggattccgatgaaacgggtcggatcagccgaagaaaccgcagcgctcgccgcgtttcttgcctctgaggaagcctcctacatcacgggacagcaaatttccgctgacggcggcagcatgaaaagcatataaaaaacatcccgctttttagcgggatgttttttgtaatgacccgaacggcaggttcagcttttgaatccgcgtgacaaattcccgcagatcctcctgcttcgacaccattgagattctgacatgcctttttccgttgcttccaaaaatttcgcccggtgtgactacgacatgggcatgctccagcaagtaatcggaaaattggtgagatgtctcaaacgtattcggaatttcagcccatacgtaaaaggttccttttggcttttccatcttccagcccagttccttttcacaaagcgccgtaaaaaagtcaattcgttccttataaattcgtttcaacgattccgtatgctccggatctccagaaagcgccgcactcgctgcctgctgcagcccgccgaacatgccgacaaatacatgatcctgaaattcattgacggcctgaatgattttttcgttcccaaccgcaaacgccattctccagccggccatgttaaatgtttttgaaaatgaataaagctctgctccgacagttttggcatcctctgcctcaagaaagctggccggtttttgatcgaattcaaacgccccgtatgcaaaatcatgaatcaaatggatgttatgctctttcgcaaaagcagcagcttttgcataaaaagccgcatcagccacagctccagtggggttgttcggatagtttaaaaacataagcttcgctttttccagcacggctggatcaatcttttcaaaatccggcagatagccattttcttcatacagcggcatttcgtaaagctcagctcgcgccatcgtaatccctgataaatattcagggtagcctggattcgggactaaagcgatgtctcccggattgagcaggcattgtgtcagcacatacaaaccggctttcccgcctccgaaaagcgcgacctccgtttcaggattgattgtcacgccgtattctcttttatagaaagcagcgattgcttccttcaaaaaaggataacctctgaatgggccgtatccatgaaacgaaggattcagagacgcctcccgcaaagcctcgacaatatgcggcggagtgggaaggtcagggttcccctgtccgagattaatgatatgggctcccgttttttccatttcctttaccttttgaaaaacgagagaaaactcctgccttggaagtgtcttgatgacatcggacggtgttatttccatctaaaagactcctttttgctccgttttgttatcccgttccaaaaacgatttgttgacgagcttcgtatgcagaaacaaaccgcatacgatcacgacaatcagccccataatgaccggagcgcttaggatgttaatgaacattgaaccaatagaaatgcataatccgatagacgcttcggccactgaaaaaatgcgcccttgaatctggtttgccgcattttcctgaaccttcacttttgcaagcacttccccgtattccatcgcgatgaaaaagaggatcgccgcgatgacagaaacagcgaatatcggtgtgaataaaaacagcgccagcgagacaatggataaaacggtaaagtacgtcaggcctctattgttgttaaagccccatttgctgacaagcgccgctccgataaagccgccgaagccgatgcagaacgtgagaataaagttaccgatttccccgtcacccagaaagcggctgacaatcggaaaatagctgtacacaactccccacagcaaagccatcgtaatcatcgtaaacatggcgtttaatacgaatgcattggttttgatttccttgagtccttccttaaaagactgaaaggcctctttaatgttttcagattgaatcggcacaaattgcagcttgatacggctgataaaaaatgccgaaaccaggtatgtcacaccgttaaaggcaacagccagctctacagatccgcctaacagaaagagccctccggcagccgccccgacgataatggaaatggttgtcgcttttgcaaataacgtgttgatgcttttaatatctgattctaaggacgacatgacagcgagacgggcgggattaaaaaacacgccgcttccataagaaataaacagcagggccagaaaaatcagcggatactcgccttttggaagaaatgtgagccccaaaaagatgatgcctctgatgatatccgtccacagcatgatcttaattctgtctaaccggtcgaccagaacccccaaaaacggctgaaacaccatcggaatgcttctgaccacgatgaccccggacgtcacccaataatcgtgataatatgtagacaaaatgagcagggcagggagaacacaatagtctcccatgaacgatagcgcctgcccgtaaagcaagtatttagagttgggtttcagctgtttcatactggcagcacatactttgccgtcagcttcgcatgctgctgaatttgtctgattgattcagccacatcctgtgaattactgcctttcagttcaaatgcagcaatggaattgaaagcttcaaacaatgtcaaatcaactgaagttcctggtgctgcggccgaaaaagaaacgatttcagtatccccttttaaaagcccgtcaggcagatcgatcgcttcaatgaccaaatcctcagcagtttctggaatctggccattttgtttgaaatgctgcgggtataaatggcagtcggcaacataataaggctcttgatccaataatccgtccggcagatcggcgtcttttccgaaacaaaggacatctaataataattgcgccatatcaaggccaaagacctttttaatattggggatcatattccagccggcgaatctggctgccgattcaattaaacctggttctctgtttttcataagcttgatctctgtatgtgttgcgcaattttgcagtccaagcccttcatttgccttttttgcagcttcgacaattttcttttttgcctcttcatccagaatggacggcgtaatgtgggatgtctctgtaaacccgatttgcggcgttttatcatgaatggcgatcgggaaatactcaccgtcagccatgatgccttctatactgatatagtcggagtacccttctgtttgataccagtctccgtactcaccctgtaaaaattcttcagcgataaacggcgcttcaaacgtaaccgcctttggcacgttaattgatttcagatagtcattgactctgttaaattcatcttctgccgtctcagtgtccgtaatcagcgttacaccgattgaactcgctaagtatgtaggctttaagataagaggtgtgccgatctcttcaagagcagcacggaaatcttcaagagttgtgactcgtttgtttttgatcgatttgactccggccttattaaaagcgtccctcattttatttttatctctggcattttcggctgcctgcacgccggcacctctcaggcccagacgttcacaggctttcgccatcggagcaatgaataattcattgtttgttgtgatggcatccgccccaaacatttcggcaaccttgacgatttgctcgacgacctcttcctcaggcttgttatgatcctcatgcgcccaataaatggaatcaggatgctcaaaatcagctaaactcttaaaatagtctttatcttttatgaccgcgaccgagtatttttcaatcaatgctgcatgagaggctgtaattgcaaaaggtcttggaataaagctgaccaggttatatttttcagcagcgcttttataaaacatgtgcggcgggcagcctccaagatcagcgatgaccaatactgtttttctctccatatgtaaaacactccttctctattgtgcggtgtatcctccgtctgcggtgatggcgcttccggtcatatagcttgataaatccgaggctaaaaacagcatcacgtttgcgatttcttcaggtttcccaagcctcagcagcggatttaccttcgccttttcttttttgatctcttcaagtgtgccttcattattttcaaggaatgatttttcattcagcggtgtgtcgatgatccccgggcatacgcagttcacgcgaatgtgatgcttcgcataatcaacggccattgatttagtcagctgcaaaaccccgcctttgctggcgttataagcaggaatatcaggccatgccacgagtccgccgacagagcacgtattaatgatgttgcccttgccggcggccagcatatgcttgagtgcatgtttgctcattaaaaacatgccggtcaaattgacttgcagcaccttgttccaatcgctgagctccatctcgtgaataggcgccacgatttcgatgcctgcattattaatcaagacatcgagtccgccaaatgtatgaaccgccgattcaactgcgtgctggcaggcagcttcgtctgtaatgtccgtttgcacaaagtgcagcctgtcattattttcttttcgtaccattgcttctccctgcgcttcatcaatatccgccacaaccacattggcctgctggcccaaaaaagcctgaaccgcagcataaccaatgcctgatgcgcctcctgttatgaggacggttttatcggtgaggttcatgatcattcatccgccttcattttttttgcttttgctctgttgtagcgcggcgggaagaagatattaatcgattttgattctttttccgaacggttgatggcaccgtgatcttcacgaggctcacagaaataggctgtgccgaatttcatctcgactgtgcagccttcgaccgtcatgtcatagccgccgccgatgcagatgccgatttgttcattccgatgtttatggaaaggcatttctccgccatttccagggattttggcaagcataatttctacccaatcctcaacaaagaacgtgacttccatgcccggcagcaggtctcttgttttgaaaatatccaaaaagtagtcctcaggacttgtatatgtttcatcagctttcagccgcttgatatcaatagcaatcacttcttggtctgtgtcgtttcttgccccgtgaggcacatgcggcggcgcgatataggcagattccaaggctgtcatttttcttgtcacatctccgacagtcatcatcagctcgccagaaacgaccatgccgatttggacctccttatgctgatggggttcaacattggtatgcggcgggacgtaagacattaatacttcagtatcccctcgtacggttgaatactgcctcactccgttttcccattcaattaatttcggtgtcgggaaataaagctcctgcatatcttctttagttttcatcatcaacgtctccttttccaaataatgaccagctcattggaatgcttttgaatgtttttacaaaggttagcccgtacttttgccgtgcaagctcattggttaaggcaatgtcatacaaaccttcttttacttttcttgcggcttgactggttgaattgactagtttgaaacgaacatctttgcgggtaaaatattttattaaattaataggtgaaggatgtgaaacaataacagatgtatcaagcatatcgtctctgaattcaaaatcaggacgaacagccaggccgtacatcggtgtatcgcacctgaagatctgcaatagctgcaaatccggcctcatgtagaaatgcttaatgccatcgtaagcatgtgggacgatggtatattccagcgggctttggagcgtcctttcgatacatgattcaaaagtatcatgcaaggacaatttactgttcagcccttgtagaagagtaaaattggaaatgaaatgctttgctgcgtactcactgcttgtcccctcagggccgagcgtgttgactgtaatgagtttggatagtgaatcagttcttttttttgtctgaatgctattatccaatataatcatgagcaccaaccaatcttttaaaattttaagtaaattttatccagcggcaattgaactgtcaatgttttttgaaaatattgataattattcccatacaaacaaaaaaaccctttataaagggtttttaattataggaatttagaaactttgtttattgagataaggactgatcgaccttctgctcaagtttgccgtactttttatatgcgaatatactgagcacaaatccgaggactgtgatggctgcgcaaatcaatccgacagctgcatagccgtatgccacatagacgggtcccattaaagcagaacctaatgtcacggccagattcgaggcgaggctgtaaaacaccatgacttttccgcgatgacgctctgagcagtcactcaaaatggtgctgagcagcgtcaccgtcaaactttgcattaatccccaaataaataggctggtgattaacagaaacatagacgccggcgcatatggtaaacacgccagcaaaacgctgatgacccctagcgcaatcaaaagggatcgcatttttccgatgcggtcggctatctttcctgtaatcacactcatggaaaacccgattccgtaaatcatgataaataagcccgcagctgtgtttcccccggtaaaaacgtcctgaagataggtgcctaaaaaggaatacataccgtaaaaaccaatcatattacaaaaagttatcgtgatataaacaggtacacgagggactttcagcgcatcccggaatgttcctgccggctcttctatttcttccttgccgctgtttttatgttgggcatggcggcgcatttcaaagagaatcagcaggacaactaaaacacccatcagggcgaaaatccaaaacgtccatctccaatgcaggacgccgccgataaatgatccgagcggcactccgaaaatcagcgccagcgaccagcttgaaacgatcagtcccatcaccttgccccggtatgtataagggacacgatcaccgacaactgcgtaagcggtcggaacaaacgctcccgcagccaatcccgaaagcgcccggcctaaaaagaagaaaaaaatattttgagctaaagcgcatatcaccgttcctatgataaaaatcataagcccggccaataagctcagttctctggagtatttatcgcctaatggaaccaaaagcggcgcaccgataaaaatcataacgccataaatactaatagataacgcaaggacgctgacatctgagttgaaggcttttgctaaatccggcagcagcggtgagatcacaagctcttcagatccggctgcaaatacccccatcgttaaagccagtgccaacaataacggaaaatgatgttttgttttgatgtcattgttttgattgctgttcattctttctcaaacacctcttccataatcttcttatcataaagttgtattatagtttagcactgttttttcattatttacaattcgaacgaaatctttataacatttattattttcatttaaaccccattatatatttctatatttcattctaaaaatacatgaggatgtaacacgtagaaaaagctctccggcctcccggagagctttttctattgcgcctctgtctgctttttttcaatcgattcatgatttatacgctttttgatgcttagatgatagtatgcatagcagaaaataatgatcggcacaccgcagtacaagccaattctttgatccggaatgaaaataaggctgatcaacacgcagccatataaacaaaatccgagaatcgggactagcggataaagcggcgttctgaactccaggtcattcacatttccgccttcagcaaggaaacgtctgcgaaagaaaaattgcgacgcacaaatggacatccacgcgacaactgtcaccatgcccgagattgagatacaccataaatacactgtttctgcggccatgacacttgtcagcagcgaacagcctgaaatgcccaacgtaatcagcagggcattcatcggcacgcctttttttgtcagtctggtgagaaaggatggacccatttgatttgatgatagtgaccacatcatacgcgacgccgcatacaaccccgaattagcaacagataaaatggcagttaagatgacaaagttcatgatatctgccgaaaatggaatgccgatttgatcgagtaccgctacaaatgggctttcaatcacccccgccgttttgtacggaaggatggcaaccaagacgaacatagcgagcacaaagaaaaacagcgtgcgccaaatgacatttcgaatggactttggcagtgttttttccgggctttcactttcccctgccgcaatgccgacaagctccgttccctggaacgagaagttcaccatgaccagcgtaaacataacggccagcaccccattagggaaaagtcctctatcagtcataaagttagacaaaaagggtgtctcctgtccgcctttaaagtcaatcaagccaaacacagcggctccgccaatcacaataaataatatgatcgccgccactttgatgcttgaaaaccaaaattccatttctgcaaagcttctgacagagagcgcattaatcaaaaagatgacgatgccgaacacgaggcaccatatccagatcggaacggagggcagccacctttgcatcaaaatgcctgctgacgtcagctctaaccctactgtattggcccagctgaaccaatacagccagccaatcataaagcctgtcgacggtcccagaaatttagtggcgtaggcctgaaacgatccggccaccggcatggcaacagccaattctcctaaacaaagcatgacgagatacattaaaaatccgccgatgatatacgcggcaatggcgccgagcggtcccgcctggctaatggtaaagccagagcctagaaacagcccagtgccaatcacccctcccaaagcaatcataaacaaatgcctgcttttcatgctgcgctgcaattcatttttatgattctgcatcatccttccccctttggttcttttgccgtgatggtcatccggtagctttgcaaaagatgaacggtggtttgctgtatgaggagaggcaatacatgaaatgtgtacggtttatagactcgttctgtccatttatggccgtcttttccatacacacccatattaatggatggaatattcagcttgcgtatgtctttgaacggaatggttccaatcatattccacccagggaagttcctgataaaagaatcaatttcgccatcggtttcgtgcagtgataaaaaactgccgtctgccaagtaggggaaaaactttttgaagacaaatgtttcgcctgtcgattcagcggttttgtcagccgcttctttaatcacatgctgcaaaagctgatctcttgcgctatcttctttcaaatagttatgcggcaggtaaggaggtgcgtaaaatagaatgacttttgcgccttgatcggggtcaagcttttgaagctcttcgattgcctgaaagcatctcatgcgaagttcaaggtgctcgttggctttgaatgtctgctcgatacactgctcgggatctatcccccggtttctcagcttttctaagtattgctccaggctatacacttgaatgtcccatgataaatgtttctttggcaggttggctctttttgcatattcttcataataatctgataatttttgttctgtctctcggcatgcttcctcagtgacttcaataagcaaatccatcatttcttttgctgttctttcataaataaaacaattgaagtacaagctggtgctgacagccgtttgcacattataggattccttgttatcacgctgatacaaacaggatgggggcagaaccaactccccttcaaccttttctgccagatggatgttattgtggagacggcttgtgatttcagatgaaattaaatttgggtcaattcctgccagtgtatcgccaacatggacttcacgcccgtaaatgtaaaagcaaggcagcagttttcccgcggctccggtatagatatatcttgtctgatcaccatcgtaaagcggggtaataaaatccgtattaatagcagccaaatagtgaagctgtttttctttttttagccggttcagctctgaaatgctggcaagaatgcccgaatgctggctctcctcatcgggattggccataaacaatacatttcccggcaacgtctcaaggttctccgaaaaatgcaggagattggctaaatgcacggcgatgccgctttgcatatcgacagatcctcttccgaacatccactcgcctgatttggcatcccgctgaacatcctgatcgaactcatagcggctgaaatactcggccaatttctcacaatcaaaagcgatatcctttaaagggccgaaatcttcgattccaactgtatccagatgggcatggtaaatgactgtattacggctttctccatgtcctttaataaacgcaaaaatatttttgcgattgtatgggtcattgggaatggcctgttcccacacatgactggggttttcctgaaaataaggatagctcgtgatcacttctttgatgaaatctgcttttgtcccttctccaacggtgccgttcacgctgctgaggctgaccagagatgctgtcagcgcctccactctttcagccggattcatgtgactgatttttgtatactgcataaattgtcctcctgatcaaaaagttgaaatcgtgcgatccgctaaagaatcgcacgattttatttctctcaaatcaaaaagcttcggacgttgttttggcttgcatatgaagaattaagtaatcgggaccgcctgcttttgagtctgttcctgacatattaaaaccgccgaacggctgatagccgacaattgctccggtacatcctctgttaaaatataggtttccgacatggaaatcctcgcgtgcccgttcaatgtgcgcacggtttttcgtcagaagcgcacctgttaatccgtattccgtgttattggcaatctccagcatatgatcgaaatcacgcgctttgcaaatcgcaacaaccgggccgaaaatttcttcctgcatcaagcgggcgttttcatcaacatctgcaaagatcgtcggctgaataaagtagccttttgaatcatcgccttctccaccggccaatagcttgccttcagattttccgatttcaatgtatttcatcactttgttgtaggatgcttcatgaatcacgggacccatatacgtatcaggatcttctggattgccgacagtcagcgttttggtcagcgccacagctttttccaccacttcatcataaacatcctgatgaatgaccgcgcgggagcccgcagaacacttctgtcctgaatatccaaatgctgaatacacgatagaggatgcagcaaggtcaagatcagcgtccttgtcgacaagcactgtatcttttccgcccatttctgcaattacccgtttgagccatttttggcccggctgcactttggcggctcgctcataaatccggcagccgactgcacgggaacctgtaaatgagacaaaccgtgttttcggatgctcaactaagaaatcaccgatctccgctccatctcccggaatgtaattcagaacgccgtttggcagacccgcttcctccatgacctcgacaaattttgctgccactatcggggctgcgtcagccggttttaagagaatcgtatttcctgtcacaatcgctgccgccgctgttcccgccataatcgcaagcgggaaattaaatggagaaatgacgatgcccacgccaagcgcttcgtaatgatattgattgaactcgccagcacggctcttcaccggagccccttccttgagctttaacatttggcgcgcgtagaactctaaaaagtctatcgcttcagccgtgtccgcatctgcttccttccacggttttcccgcttccttcacaagatagcctgaaaattcatgctttcttctgcgcaaaatagccgctgccttaaagagaatattcgcgcggtgctccggtctttgttttttccagcaatcaaatgcctgcaatgcggcttgcatcgctttttcagcaagctcttgatccgctgtagacgcgtaccctatgatctcttctttatttgccgggttaatagaaatgattttgcggtccgtttcaattttttctccatttatgacaagcggataatgcttgccgagctgagtgtttacaaaggccaatgactccccaaatgcagttttattctttgcttccgtaaaatcggtaaatggttcgtgcgcgtatgtgactgtcatatgtagtccccctcgtgttatgaaatatatcttcgcatatgaataaaaatgcaagaatcatgccattttcttgtcttttgctgaaaaaacttgttgaatcgaacagaaatttgtctaacaggtgatcacctttctctttttccgatcttgaacgcaaatttattttgcgatttttgctctttaggcaaaaaacaaacgcaaaattattttgcggaggcttctcaaattagacccatccgcggaatcgcgatgcttctgccgattttctgatgcccgtcatgtaagccgccaaacgcatatccactttatgtgttgccgctgtttgataaattgtttcgaacgagctgaccatgacgcttctcagtttttctgcaacctcttcttccgaccaataatatccttggttgttttgcacccattcaaaataagaaaccgtgacgccgccggcactcgccaggatatccggcacaagcagcacgcctctttcattcaggatcttagtggcatcaatggttgtcgggccgttcgccgcttcaacgacgattgacgcctgaatgttatgtgcgtttttggctgtgatttgattggagatcgcggcaggcactaaaatatcgcaatccttttcaagcagctcctcatttgtgatgacgtcagtaaataaattggtgaccataccaaagctgtcccgtttatcgagcaaataagggatatcaaggccgtctgggttgtagagcccgccattggcatcagaaatcccgatcaccttcgcgcccgcatcgtgcatgaatttggccaggaagctacccgcgtttccaaagccctgtatgatgatgcgcgcgttttgcagcttgatcccttttttcttcaccgcctcttcaatacaaatcgtgacgccctgtgccgtcgctgtttcccgtccttgcgatcctcccaaaacaagcggtttacctgtaataaagcccggagaatcgaattcccgcagccggctgtactcatccatcatccacgccataatctgcgaattggtgtacacatcgggagctggaatatcctttgtcggaccgacgatctggctgatggcacggacataccccctgctcagcctttccagttctccaaatgacattgtccgcggatcacaaataataccgcccttcccgccgccgtaaggaagattggcaatcccgcatttgagcgtcatccaaatggataatgcctttacttcctcttcattaacttctggatggaagcgaacgccccctttgtcggaccgacagcatcattgtgctgtgaccggtagcctgtgaacactttgacgctcccattgtccattttgaccggaatgcggacagtgagcattctctgcggctctttcatgagttcatacatatctcccggataacccagcttccgaagggcttccttaatgattgtttgggtagacagaaataagttaagagcttctttttcttcatctttcgagacttgctttgctgacatctttttcacctcattgtttttttggccggctgtaatgtaagcgctttaaaaaatcagcccgccaattcctttcttcattggattcacccttatcatcatgcaagatccgtaccagcttttgaatccacaaaaaaagagactgaaaacatctcagtctctgactacaaatctatcgattaacggggatcaatcaccagctgcgtttcagcataaaaactgccgattcccaaaccgtttactacatcgcctttaatcgtgtaagtgcctgcgcgaggaagagttttacgcaccatgacaaggtcaaattcggatgcgcctaacaaatcaagcgtaagcgggagtctgactgtttttccatcgtttaaaatctgtgtttctttcagtgttcttccattcactgaatctcttgtcgtagcatgaaacccgtcaggaaattgaaattctacagctccgagagaaagcaccgcatttggtttatatgtcacttcaatatcagaagtggtccactctttcgtgctgttaattgtttttgcctcgattgatgcagactgtgcatgagcttggcccgaaggaagtaagattgatagtaaaacagctgaactgatgaataatgaagatacgaatgaagttctttttagcatgacatttccccctaattgattgttgaaatttggccagagcgtcctctgcagaaaaagcgctttttcataattcgcgaattaccagttctttttcttaaaaattaatctatcatcattttccatggaagtaaatgttttttaaggaatattaacacttggaattcaatgagaattccttcctgtttatacaaggttcaaatggacgatttctctctctttttctagtaacatctgcccgacattttctatcttttatcctattttaaaaaagggcaaaaaaagtcgaagatgcctctgctcttcgattgatcacgttcctatttttatctgaattcagtgttccagttaaaaccgatcgtctcatcattccacggaattcttttttcatcaggctgatccgggttatacgacatggtggtaaaatagataattgtcagcggcgtctctccagcactctatatccgtgagccaccccttttgggattaataacagcatcgggttgtcttcgcccatataatagacgtccgtttctccttttgtctttgaatcctctcgaagatcgtataggacaacctgagcgtggccggttgggaagaaccagagatcatcctgcttctcatgataatgaaatgccttaatcacacccggatagcttttcgaccaagaggcctgcccaaaatgctcaaggagattctcatcgtcccggaccagctcagcaaaaaagcctctgtcatcgctatgcttcatcaattttttcaccttgactccatcaatcacacgcactgctcctttcctgcaaatactctcgtaacgcttcccgccagtggcgggggcggatgccggcttcttcaatagcccgatggctcagcacagagtatgccgggcggggcgttttgttcccgtattcctctgtcgttacaggcaaaatggctgtttccagcccgctttcttccataattgccgtcgcaaactcataccagctgcatatgcctgaattgctgacatgatagatgccccgcggatggctgaacagcttgatgaccgcttctgctaaatccttcgtataagtcggcgaaccaatttgatcgctgacaacccgaagctcttgtttcgtttcagcaagcttcagcatggtttcaacgaaattattgccgccatgtccgtacacccacgatgttctgatgatcgtgctgtcttttgtcgttaatcgtatcagttcttctccaagccttttgcttttgccataaatggttttcggatcaaggggatcgtcttccctatatggctgggttcctttcccattgaatacatagtccgtgctgatatgaacatattgagcaccgatgcgggttgactcaagcgctgtataataagcgccgattccgttaaccaagtacgctttatcaagctctttctcgcattgatcaaccgacgtaaacgcggcgctattgaccacgatatccggctgataatggccaaacgaatgccgtactgagcgctggtcagcaatgttcatcatcttctttgttaacgcaatgacctcatatccggcttgcttcagctggcggcatagttccaagccaagctgtcctcccgccccagttaccaatacctttgtcaatcagatcaccttctcatcggtcattgtctgtataccactgaatcgtacgcgcaatgccttcttcaaacgtcacttcctgccgccagcccagttcatttttcagcttagatgcattgatcgcatagcgccggtcatgcccttttcggtcttccacgtgggcgaacaattcctcacagcccagatgcttcaaaatgacactcgccagctctttattcgtgcgttcatttccgccgccgatgttatacacctcgccgtcggttcctttttctaaaatcagtttgattgcgcggcaatgatcctccgcaaacagccagtctcgaatctggagtccatcgccatacagcggaacaggcaggccctgcttcgcatgacggataatcgtcggaatcattttttcgctgtgctgataaggtccgtaattgttgctgcatcgtgtaatgatggccggaagcttgtgggttttcacataagacaacacgagcaaatctgagcttgctttgctggctgagtatgggttattaggagaaagcggcgtcgtttctgtaaacgcgggatcatccgcttttaaatccccgtatacctcatctgttgaaatatgaatcagcttcttggcttttcctttcaagaccgcttccgccaatcggtaagtccccatgacatttgtggtgataaacggctccgcttgggaaatgcttctgtccacatgcgattctgctgcgaagtgaatgacgccgtcgtaggtctcgtcaaacgcccggtcgatatcctcctgaacgctgatgtccccttttacaaagcgaaaacggctgttttgctgtaatttttccatttcctccgggtggctggcgtacgtcagtttatctaaaacggtaatgcgcgcatccgtttccctcagcatgagctttgtaaacgtgagcccgatgaagccggccccgcctgtaattaaatatgattttgccatcacttttcgtcctgtcctttccgtagagcctggtgtacaagctgggaagcgagataaagcgattcgtgagttccggcatctacccaccagcctgataacacatcatacgtaagctggctgttttcgatgtatagattattcacatcggtgatttccagctcgccgcgctttgatggtgatatttgttcaatatatgaaaacacctctgcatcatacatataaatgccggtaacacaaaggttggtcggtggctgttcgggcttttcgatgatggaacgaatccgcttgtttttctcatcaatctcagcaatcccgaaacgttccgggtcatcaacttctttcagaagcacttttgctcctttcccctgttgttcaaagcgttctgtataaggctttaatgaatcttcaaaaatattatcacctaataataaaatgaaagactcttttttcgtaaagcgctttgcataagacagtccatccgaaatgcccgatgctgccggctgtacttgataagtgatagtaacgccaagctcttctccgttcccaagcagtttataaaattgcggcatatgctctttttggctgatgagtaaaatgtcttttattccggcttcctccagcttcataatcgaccagtatatcattggatacgggcctacaggaagcaaatgcttgttgacggctttcgttaagggcataaggcgtgagccgtttcctccggctaaaataacacctttcacattaacacttccttacatgcatttttatatcttttgttcatataaatcttgaagaatagctgttacccgcataatgcctttgccatccacgagcggccttcctcccttatgcaaagaaaggcgaagaggatagctgctcataatgcgcgacatctgatagatgagtgtttcatccggtacaagctcacccaatccaagatcaagagcggcgccttggtcagcaaatgttttggctgtagccgtttgatgctcaacctgagaaagaacaaggcacggcacgccgatgcaaatggcttcatatagagagatgccgccggcgacaatggctgcgtccgcttgtttcatcaaacctgccatatcatttgtctgttcgatcatcttgtactgcggcttcttttcgatccgccttcggactgcctcttgatgcggtgaagcgctccccatcacaaacattatgtttttgtcttttatgtcggggacttgatcagcggcagccagcactttaaaaataagctgcttcggatcacttcctcctaatgcaacaaggatattgcggcagtctttcttaagtgtgtaatcctctcttgcggcctgaaaggcggggtgaagaataagatagtccggaccttcatagatgcgtgtgtttccctgaacgtacaccctgcttctgatgtcaccgtaaattccgttaatgactgcgtcactatattgaatcgatttaccgtttttctcttcaaaaagaacaattttcgcatctgtctccgtctttattttctttaacagctctgcaggcgcgcctagaatatcaaacaaaagcaaatcaagcttcttgctttttatttcccggagaataaattcgtgctgctgtagctccggctttacgatgacctgccaatgctcttcatgaagaaacgcttcagaatcctgattcgtataaaacgtaatcaagcatcgctgtttgagcccctccgcaagtctcttcatccggacaacatggcccatccccttttcatagccgccgtctgcgaagatcccaacatgcatggctattcagcctctcgttcgattgccgcatcgggattccggttcagaagggtgataagctctgaggcggatacatcggggcgctcgcctgctttttgatagagagcctttatcgattcatagtcttcctttgtatcaatggtcagccgatattgaggggcgcgaaatcgttccggcgcctctaaaaactgaacacgataaagagctggatgattccttatatataacgtgacatgctcctgatattgatcctccatattctgaatacggctgatgtcaattaacaggttggcgttgaccacttcgccgcaaatccctaatggggcattcaggatatacgtataatccgacccttgatcaaaatgcgccttaatcattacatcgagcagctccggatcgacaaacggattatcacccgttaaccggatgatgactgacggtttaacagcttctatgaccttcacaaacctatcgaggacacgttcttcgctcccgcggaaaacacgaaagccttgtttgatacagtgcgcctctaatatgtcgtcagtttctttgtcagacgtggcgatgacaagattatcccgatccttttggtaaaatgcgctttgccggacacggtgaacgagaatatcaagtaaacgattcgatccgagcggtcgaagcacttttcccggaagccttgttgaacccattcttgcttgaatgataaagagaatatcattcatgaaacgggctgtccttcagtaaaatgtcatcccagacaatgcctgtgtcggccggaatgtctcttacagcccgaacaccgctggtcagcagttcaaaaaatctcgggtgcagcccctgcggcttttgtccgggccgaagcactgcgatattgtcttcactgaaggcttcacctttttgaatcggagctgttgtaaaaatgcctctatatgcaaagtttctgatttctccttcgatggcggtcgttgttttgtatgaactgccaagcagtttttcagagaccggctttgtgatcccctgtttcagctcagcttccgttttcctgatgccatcgaccatttctttcaattcatccggatttaatgcaaacgagtggtcggcacccggcagatttttatcgatcgtaaaatgcttttctatgagttttgctccgagccgaaccgcggcacacggcgcttctgtcggatgctcgctatgatcggagaagccgattaccgcctcaggaaaagcggcggcaagcatcggaatgacgctgaggttgctgtactccggcggtgctgggtatttcgccacacaatgcattatggcaatttgattgtttccctctgccctgatggtgcgccaagcttcgtgaacatcagagatttcagctccggctgtcgagaaaatcatcggcctgttcagccgggcgacatatttgagcagcgggagatggttaatttcataggatgcgattttaaaagcgctcggcgaggtagactgaagcagatcagctgacctctcgtcacataccgtacttaaaaagatcacctgcttttcgcggcagtaatccaatagcggtaaaatccactcaacaggcatttccatagattgaaccaaagaaaaaatagagacgtccttgcccgctgccgtcttgtacaaaccaggatctttctggtacatcctatcagcttggaacatttgaaatttcacggcatccgctcccgcttccgccgcggcgtctatcagcgcaaaagcctgatcaagcttcccgtcatgattaatccccgcctcagcaataataaaaacaggagcgtctttgcctacagttttattcgcgatctgaaacgctgccattatttcgcctccttgcctggccaaatatgataatagtaatacgattgttcagcggtgaagcccattcgttcataaaggcggatcgcccttacattgtgaagctgcgtccccgctgttaccgttctatgcttctgggtctccggttgttctatgagattcgccaataaatgaaacgcaatacgtttcccttcaaatcccggctttacagccatcaaatcgagaatgcactcatcatctcttgataagccctgaagatagccgatgacctcgccattgtatttagcgacaatattgaccgccgcccttccattcagattgtttcgtgtccactcctgaaatatttcgtttgctgcatcgcggctgagatgaggatcctgaaaatatctgctttttgtaaacgagtctcgggccagctcacatatcgcttctgtgtctccgggctcaggcgggcccagttcaaaaaatggcggtgttttgtcataaaaagacggaggcatcgccagcttcagcaaactcccgacaaagtaagaggatggctgctgttgtatcacatgcgcggctccgatatcttcagccggaacacggacaaagataaaatccgtttcatccatttggcgtacagtataaaaagcttcaaacagcctctttagctgcccggtactatttgccgcaagaagtttgacgttcatgactttcttctgaagcaccttgctttcccacaaagaatcttcgtaaagcaatacgccttggagcctgctgttttcaaaaaggccgagggaaaattgatacggaacatccagtgtaagctttctgctttggagaaattcctcaattgcctctttggaaacattttcttttaccgtatacacttaatcagccccttttacgatatcccgcacagcttcaatgacatcatctacatcgtcgtcagacattgatggatagagcgggagagaaagggttcgtttatagtaattcatggcattcggaaagtccgcttccttatatccaaattgcttttgataatacggatggatgtgtactggaataaaatgaacgctagtgccgatattgtattcatcctttaaagccgtaatcatttcgctgcgcgtaaccccggcctttttttcatcaacttgcagaacatatagatgccaggcgtgcctgccgtcatcatggacaaacggcgtgatcagcccaggaatctgctgaaaagcggtttgatagcggccggcaatctcttctctccgtttctgcatatcatccagccgtttcagctgatgaagtccgagggccgcctgcaaatcaaacatattcatcttatagccgggcgattcgacttcatagtaccagctgccatttgaagaataacggttccatgcggctttactcatgccgtgaaggcttagcacccgtatcttatcggcaagctcctcatcatcagtcgtcagcatgccgccttcccctgtcgcgaggtttttggtggcgtaaaagctgaatgccgttgcatccccgatagaaccgatcattctttgcttataagtcgtatataccgcatgtgccgcatcctccagcacgaataaaccatgattttgggcaatagccaatattgcatccatatcgcaggactgcccgccaaagtggacgggcacaactgctttcgttcgcggtgtgacggccgcctcaagctttaccgggtcaatattgagcgtgttttcgtcaatatccgcaaacacaggcgtcgctcccgtatgaataatcgtattggcggtcgagctgaacgtaagcggagaggtaatgacctcgtccccgggcccgatcccttttgctttcaaagccaaaaataaagctgcggtacatgaattcaccgccacggcgtgcttcgccccgacaaacgcggcaaactctttttcaaactgctgaaccttcgggcctttagagagccatcccgattcaagcgtttctgtaacctcctgaatttcttccttaccgattaacggcaatgagtaagggagaaaatgatttctcttttgcaccatttctttgcgctcctatcattttattcagtatcttcccgcctgtaatcaacccctgttttggctttcagttccgcaaataaagcatttgttgattctgccaccggataattagccgctatgaatgccaatcgcgcctcttctgctttttgatgcacgtcgggccttcgaagaacttcaaccaaggtgtgcgctagttcatccggctggtcaaacataaaatcgccaagagactcataatacggatacgagcgatttccggacgattttccgatcagcacaggcttttgaaacagcatggcttcaagaccgactgtcgaggtttgcgtcactgcggcatcagcatacggcagcaaatcataaagctccagctcctttttgatgactctgcatgctttatgttttttcgccgcctcgtgatacagatcaagcttgttttttccgatttcccacgggtgaggtttgataataatctgcagctgcttctgatcagaaagcccctgcagcacaccggaataaaagtcttctgaaaagggctgagtggcaatgagcacaatttttttagtcggctgaaaagcaagttttcgatagaatatggacatatccataggcgttctgttaaaaatctgatcgaaccggggatgtcccgttacgagaatctgctcgggtttacagccttttcgtatgaaccactctgcttcatacgcaccaaaaacagcttgataggttgtaaaaacaggaatgaaggcttcatctcccatcaatgcgccatgctgaagacaaatgctgacggccccttttctttgacacatgagagcgagcaccctgctgtaaatgtcttctgccgttccgacaataacagctgaaatcttttcctgttcaaacagcgcatcaactgtatcaatggcctctataaataaaggaatatctttgaaaagccggtcgcgaaacgcttgatcaccaaatgccgggtgatcatcataaggggcgagaagcgaacaggctgtttcgagatactgcttcgaatcgcctttttggcatgaatccgcaatctcccgcttgctaattacaggcagatcacaataatgcggcaaactccatctggccaaaacagccgttttttcaggatcaaattgatagtaattttcgtttgaaaaacgcaggtaatcaaagtgcaaaatgactttccctttaacaggtttgacatttgttttaacgatgttttggattctttcttcaaaaaacggctgaatctgtccctcatcgatatgctgatctaccgatccgaataattccggttcttcttccatcatcaccctcagctcagggctgatgtattgataaaaattactgataagcccaagcggaatccctttgtagcgaagtttgtcaaaaagctccacgtacttccggtacagcacccaataattgcttaaataggccgacaagctctcaccccattccaagcttttttaatgattcacgcagttctcggcaatttcgctgcggaggaaggttcctgacaaattcatttttttctgattcaaacagctgaaagtgaatcgattggtcggtaatataattcaggtccagctcctcatccagtgggtaaaacggataaaaatgattgactctccaaaagaaccgggcatctccaatacggtaaaacgccgggctttcatcccaataggagccaaacttctcctttaccttctcaagcaccgaatacctgtgcatcaccgagcaatgatcaattgcgcacggtgcgttccatgtcacttgagcggcaggcctgacagtttcttttacaatgtcgcgattctcgtttaaatgataggttttggaggctgagtaaatcacagccttttcaggatgggtatcgagctcccgcaccattttcaggaggcggtccggcatatagatgttgtcatccgtcgcataggtgatatattcaccctccgccatctcaatcgcctgattgatcagtgccgcgtatctcgttttttctgttctttccttcactccagatacatcgctttgataaaaacgcactcggttatcattcaaaaaaggacggattacattcagcgtctcttcattggagttgtcatccataataaacaattcaaaatctgaaaacgtttgtgagagtatgctagaaatggactttgccacataatcgcttttgttatagctcgtcataatgactgatactttcggcaaatcctacacctccttcttggaacttcacacctgaaactatcgttatcttatgttgcttatgctcaagttgcgctagggatacaaaccaatatgcgaaaagtttgtgtatgtctctgaaaaacagcggatgcccagagcgaaatctgatcggtccgctgttctttttcagcataatccaagcatcagcctcataaggtgaaagagataaaaatcgcaccagcgactaagatcgttttccatcggaggtgagtcatcgcggagcgttcacctatacatccagaacatgttttgaatggttttcataaaaaggaggaacgatatgaaaccgaaaaaaaatcaatatcagcaaatgcaggcatttgataatatgcaggggtatcagcctcagtttggtgccaacccgtacccgcagcaaggccaaggctcacaaatgcagccaatggggatgcagccaatgatgccaatgcagcagggacagcaaggacaacaaggacagcagggatttggattcccgggccagcagcagggcggcggttttcaaattccatcggggcctacaccgtcaggaccgggccaaagcgttcccggcatgctgcctgttgaggaatcttacatcgagaatattttgcgcctgaatcggggaaaaacggccaccatttatatgacatttgaaaacagcaaggaatggggctcgaagatttttcgcggcgtcatcgaagctgcgggccgggatcacattattatcagcgacccgaaatcaggaacacgctacctgctcctgacaatctacctcgattacattacatttgatgaagaaattgcttatacgtatccatattccatggcgtcctattcgccaagataagaaaaaagccaatcactcatatgatgaggattggcttttttgtttatagatatttgacggctgcgacaacgatcataatccaagaaataataaacgccacaccgccgagcggggtgatcgctccaagaatggagatttgcgtcacacttagaatatataagcttccggaaaacagcacaattcccgcaaacatcagccatccggctgtcgtgacactgcctatgccggataatttatcagccagaaacgcgacaacgaataacccaagggcgtgatacatatgatactgcacgcctgtgtgccaaacctgaagatatttatcaggtattttcccttctaatccgtgagcgccgaatgctccgagtcccacggcaagcagggcgttaatagcccctaatatgataaaaactttcatctatctctcccgccttttcgttaaactcatatcatttatcttatcgcacctgcaccaaaattcaatgtttgttctccgttgacacgagattgtcggattttctcctgcgccaaagctggaactggtcagccgctattgcagcaagcgtacctaatacgagcccgttgcttaatagagaaataaataccggatgcaatccctttaacgcagtttcaggaacaaacatgataccgacccctgtcagcagcgagatgccgatgatagacctcaccctttttgattcttctttctcatatgaatcaaattcggcaaaggccagaccgcccattgcggagaacacaacaaaattcaccgcaaatccaacgggtgacggcaggctcgcaaacgtattcataaaaaacgggatcacgctgatcacgataaccagaatactgccgagcataaacggttttttagaaggcattttggtcgtttcaataaaacctgcggctcccgaaatcggaacaggcgcaatggctcccgtcaaaccgctaagcagatggctgaatgaagcggcaaaaccggcatggcgttcatgatgctttccatcaggctgtttgctgaattttttcacggcgatgtccacgaccttcatgctcgccagcatattcacgatcagcaagatggtaataaaaatagaagtgatgatcaggccgctgttaaataatggtgtcccaaaaggaaacagggaaggcagctgaaacagccggtccggcatttcaatcggctttgccgctccggcagccgcaaacagcacccatccgccgaacaaggctaataaaatagaatattgcttaaaaaacatgatgttcgaatttgtcattataaaggcggcagcgatcacaacaagcgccaggccaaatacaagaccgtccaccccgtcctgtcgataaccgattccgagaattccttttataatgggctgactcagctgcatgacaagaagcaataaatagacgcccgttacaaccggagtaaacaattttgcaagtctgtcaatgaccttgaaaacacttaacaaaaagaaacatacagcgcttacaagaagagctccctgcaaaccccgcagtgtgtctccatatgtcgcaaacacagttcccgtcagccctgcgtagatcgtatacactccccaccacaagccggctgggctttcattaatcggcagtctgtggcctttcaaacactgaatgacggcggcaattcccagtacaaaaaaagtgctttgaatcaatcttgcagaatctgagtgatccagatgaaacgactgggcaaccgccaccggaacaactatcgccgcagcaatgataaacgctgtccattgcagcgcgccaagaaccaatttcacgtaagctcaacctctctctttaaaaatcaaataaagactctccgtttccatcctcttcctgcttctctttttcttgctttcgaaatttgtttaatcccgcgctccccatcattttttccatcatcagctggtctgtcgatggcggcgcggcaggacttggcgtaacgctcggctgtatgcggggcgcgctcacgttctccggctgatcaagcacgacatcacacagagaacggacaaccgctacataacgcttcagctcctcatcccgttcagctgtttttgcttttttcagctcctcttccatcttttgaattaatgcagatatatgaatgttcatgaagcaccctccaaaaaaataaatgttgtcttcctgcattttatcaaattcctgctgtaaacgcagatatgagtttgttattttttctgacaaaccttgcgcgattgacaagcagaagagatttttcacataataaatcaccataccttacaaaaaggagaaacggaatgaacagcatcccctctatcatcagcaagcataaagcctattttgcggcgggacatacgagaccgcttgaatcgagactgaacattttgcgaaagctgaaacaagccgtcagaactcatgaagccgatctcatagccgctctctaccaggatctccacaaatccgagcaagaagcatactcaacagaaatcggaatcgtcttggaggaaatcagctttgtcatgaaacggctgagaaaatggtccaagccgaaacgagtcaaaacgccgctgactcatctaggctccaaaagcatcatcatttctgagccgtatggaaccgttttggtgattgcgccttggaattatcccttgcagctggcgctttctccgttgattggagccattgcggcggggaacacggtcgttctcaagccatcagaatatacgccggctgtttccgctgcactttcgaaactcatcagcagcgtttttccgaccgattatgtcgctatggcagaaggcgggcccgacgtcagcacagcattattacagcagccctttgactacattttctttacaggcagcgtagccgtgggaaaaatcgtcatggaggccgccgccaaacaattaattcccgtaaccttggagctcggcggcaaaagtccctgcatcgtccataaagatgctgacattcagcttgccgccaaacgcattgtcttcgggaaatttacaaatgcgggacaaacctgcatcgcaccggattatttatttgtccacgaggacatcaaaacgaagctcacagaagaaatgaatcgtgcgatcagagaattttacggtcctcagccggaacggaatccgcagtacggcaaaatcgtcagtgaacggcactatcagcggctgctcagctttctgaatgacggcatcccactcacaggcggacaatctaatcccaatcatcacaaaattgcgccgaccattctcgaacaagtgagggatgactctccagtgatgcaggaggagattttcgggccgattcttccgctctttacataccgcgatatcggggaagtcattgaaaaagtccaatcgcgccctaagccgctcgccctgtatctcttcaccacaaacaaagaaattgagcgcgctgttttaggaaatctgtcgtttggcgggggctgtgtcaatgatacgttaatgcatgtggcgacgccgtatttgccattcggcggcgtcggggaaagcggcatcggcagctatcacgggtttgacagttttaacacattcacgcacaaaaaaagcgtcgtcaaacaaacgaaccgcttcgacttcgcatttcgttatccttcctccaaaaacgggctgcgaatgattcgaaaaatactcaaataaaaaagcgcagatcacctgcgctttttacaaatccttaatacaccaatcaatcggcgcctctcccattttctccaaataggcattcgcccgggaaaacggtctgctcccgaaaaatccgtttctcgccgaaaacgggctgggatgcgtcgattcaatgataaaatgcttggacgtgtcgatccgttcttttttcatttgggcatgccgtccccataaaataaagataaccggctgctccctttcattcagcacgtcaataattcggtccgtcagtcgctcccagccttttcccttatgggaattcgcctgtccgcgccttactgtcagcacagtattcagcaaaagaacgccttgctttgcccagctcacaagcgacccgtgattcgggatgctgcacccgatgtcctgctgcagttcaagaaaaatattttttaacgaaggcggctgctttacaccgggcttgacagagaagcttaaaccttgagcctgtcccggcccgtgatacggatcttgtcccagaatgacgaccttgacatcatcatatgatgtataatgcagcgcattgaaaatatcccggctgtccggataaatcgtttgctccgcgtattcccgcttcagcatttctctgagctcttgataatacggtttctcaaactcttcctttagctgattccaccagctgtcttgtaaaagctgtttcaagattcaggcccccttacgaacgatgaagtctggaatagacaggctcgccatcccaaaccatttcactttttgcttcccgcctcttcatctcaggctcttcaagcaggacggcaaagtttttcgtcggcagctccccgagtccgtgcttttcacttaaacgatccaaatattgcttccgcttggcgccaaggtccgcagactgattgtctcccgcgtcactgaaggcataaatcacactggcgcaagggacacgcttcacccggtaatccttggccgcgcgtaaataaaaatcccaatcccagtaattgtgcacatcagcatcgaaatacccgatttcatcatgcagaaaacgtctgtacatgctgcccgacggcacgtatgtagaaaacactctcatatcctcatagtcagcggtataagcaaacaatttccgtgacactggatatcttgttccgtatttctcttcaaacgaaactatttccgcatcagaatgaacgaagtcagccgtttctatttcctttgccattttctcgatatgccctggcgtaaagaaatcatcgtcatcacacagcataatgcaatcgccagacgcctcttttacaccggcatttctcgcagccacatgccccgagttcttttctaaattgatgacagcaatcggcagctccggatacagtgctttgaccggcacgaccgattccccggcatcattcacaataataatttcatacggcttcaaggtctggcgggaaatcgactccaaaagctcacacaaagccggaatccgattataggtcacaattacgatagaaatcttcatgatgctctccttctcattttcatagtcatgtactattaaaacatatattgaacaggagatcagtgggaatatcctactgaaacggcatactacaatgatagaaacagcaaagtggctccgatcagaagcaccatgatcagcatcagatctccaaagacatgaaagatatctttcatgcggacgccattcggaaggataagacgccacagcttagattgatagaccggcagcagcaccagtgcataagaaagacacaaaaatgtaaaagccggcggcacaaaagcacagcctgcatcgtcccaattcatcatgatgtctttcatactagatccatccaataaaaacaaagatatcatgagggctagcaacacaaaggaccccaattgaacctcaaacaggcgcattttctggttatatgcaaatcggaccgcccaaaaccagacataagcatatgaacatagcagcgtaagaatggcacctgctgtaaagacgacatcaggcagccgatcaagcagaaaaacaaaaggcaagctggctgccatagccaagagcatgcagccaccagtaaacaaaaatactgccccatgagctacaaaaccatataaacaagagctaatcctcacgacatacacctcctttacatagaaattctatgtatatacctaaaaaatcagacaagctgacgcctgccaatataacagcccattcggccaaataacggaaataacagcgttgcaaaagcacaagttccaacaaaccaaggtgtcaacaaggattgaaacagcgcagcaggaattacattgaatagaaaaacaagcataaaaatgacgtttggcaccattgagatcagaatcgtatgtagaacaagcttttctccgcgttttccaaactccttcacgccttgatacccaatcagcacccagtagatcatatatgcagctaagatcagccaaacagaaacagaaatgcctttccatactgcttgaacaaacggtgattcaagccatacatgcattattgtaatcgcaatgccgacagcgaatagggcactgttacagaaaagatggaacatcaaaaacgcacggaacgttactggctgtattttcttaaacgaagaaacaatgtcagttggtgttccaaacgcctgcaataaagtctgcatagcttcctcctcactctttccttcctgaaaagagcaaaacagatgatgttcaatatggctctcaatctcttctatcattgcctcgtcttcaggaagccctttaagcccgcttttgatttcggatacatatgtttctttatccattttgtccgctccacttcagtattcggtccatcatggctgaaaatacgctccattccttcgtgcgttccgccagcacttctttgccttcgtctgtaatccggtaatatttgcggtccggtcctttctcctgcttctcccagtaggaagaaatatatccttggcgttcaagcttgtgaagagaaggatacaaggtcccttctttcatctgcagttcgtttccgctgcggcttcccatttcttttacaagctcatagccgtacatcggccgctcgttcagaagcgtcaataccaatataaccgtgcttcccttaaccagctcacgatttaacatctcaaaacccctacctagttttcttatgtagcattttacgaaagcaccttgagattgtcaaatgattcctatagatcttctatattgtgatacagagaaaatctaactataatgaaagacaaaacacgatggaggttcaagacatgtctatgcataaagcactcaccattgccggctcagattccagcggcggtgctgggattcaagctgatttaaaaacatttcaagaaaaaaacgtatacgggatgaccgccttaacggtgatcgttgcgatggacccaaacaacagctgggaccatcaggtattcccgatcgatactgatacaatccgcgcccagcttgcaacaattacggacggcatcggcgtggacgccatgaaaacaggaatgctgccaaccgttgatattatcgagcttgcggcaaaaacgatcaaagaaaaacaattaaaaaatgtggtaattgacccggttatggtttgcaaaggtgctaatgaagtcctttatccggagcacgcccaagccctgcgtgagcaattggctccgctagccactgtcattacgccaaacttgtttgaagccagccagctcagcggcatggatgaactaaaaacagttgacgatatgatcgaagccgcgaaaaaaattcacgcactcggcgctcaatatgtcgtcattacaggcggaggcaaactcaaacacgagaaagccgttgatgttctctatgacggagaaacagcggaagtccttgaaagcgaaatgatcgatacgccttatacacatggcgcaggctgtacattctcagcagccgtgacagcggagcttgccaaaggtgcggaagtcaaagaagccatttacgcagcaaaagaattcatcactgctgccattaaagaatccttcccgctaaaccagtatgttggtcctacgaagcattctgcactgcgcctgaatcaacaatcataaaaaaaggggctgccttacagagaggcagccctttttaaatcaccgaagacttttcacagaaaaaactgccgatcccatcggcagcctgtttatttgatttttaaattgtttgcagatttcctcaaaaatgtttctatcgactgaacaaaaagtgcatattccttcatttgttcatatgcccgcgtgagaatttccgccgtttcactgtgcggcgttgttccgccaagcatttttttcagcagaagcagcacatccttatattcttctcgcttatcttcaacttggttagcagccttttccaaacattccggtgttatcttctgttcatgtatattcaagaaaacaactccttttacagaaaaaaatagtaggttatcgttgaagaatagcacagatggctcagatttcacataagaaaatagaaggataatttaatttagattatttcttactaaatttcttatttttctactttaaaaaacagttccgtacaagaaaagacataaaacatagtatttttatattcctccggaacaacaaggagaccacaaagcaccaattaataaagaagcattatcttttttgtattcaggttttcattacataccatatagttaaatagacatttgccagtttacgattaaaacaatttaacagttttaattaactagtcctggagtacaaaatgtgcctaacggtacactaccattagtggctgtaccgtgatatgtagctttaatttgattatttgtaaggatctcggttgaatataacggcaaaactccataccagcatcctcctttattggaaatatacaaaaattaggacggacatcttcaattttttgataaatcagattaacctctacctctttcgtatccccataactttgaggtgaaaaatccattgaactagcaagtgttaacgaaggtgaacataccagacaaatgacgaataagaaaccagttaaaattttcttcactttaaaccctcctaagttataaatctagaatttattatacaatatatatctaatatgtaaatatatagatgtatgttgtatatagtgattaattacaattaatcttaagtgacagataaatctctttatttttccattaagtgtagtcatcaaaaattatcttgatactattcaacttgacataaggctcttataaaaaaactgccttttaaaaattaggcaggttttttcgaaacctgtgtctataatttttcaaaaagaaactacataagtgtccaaattccgacattcatttcagatttcccggtcgcactggctgttacttcatgatttcccgggaaaggaaaatatctcgcactaaagacctcttctccgttattcataaagatttccacagatgacgcgtcgagaaacatgtgtacggtatgcaaatccttgatgcggcaatgtctcgcttctgttctttttccgtcaaagctctttcgttccagcgtaacaatcccctcgtctttatggaaggaaaacgtagccgttccgcggatactgattgaaaagccagactccgtatgaatgtcttccagcagaatctcagctctttcaggtttttccactggaagcgcaccagatgatccatgcatgttgatgtgtatttttttctcatttctacgcatggcttttagctcaggcagcggctgctgaatcagcttctggcctgaaagcgtcagctgtctcggcagcgtcatgcagtgaatccagtggcagtcaatggtcggatgagacccttcatcctgatcaggcaccgccatccatgcaaacaaaatccgccttccctgatcgtcttcaagtgtttgcggcgcgtaaaaatcaaaaccttgatcaagctccgtaaattcaccatgcttcagttcaggcttgctataatcgagacggccgacaaaataacctgattgatatacgttctgataacggaaaccgtcagcctcaagcccttgaggcgaaacaatcagcacgtccgatccttgaagggaaaacaaatcagggcattcccacatgtatccaaaatcgtccagcccgttgaagcccgcgccggttatcgggccaagaaatctccactcactcaggttatcagaagcaaacaatacagcctgccctttcaaattctctgtttgcgcaccaatcaccatataccatgtgccttcatgctcccataccttcggatcgcgaaaatgcgccgtatatccttccggaaggcgggcgacaacaccctttttctcaaaagacagcccgtcgtcagaaacagcaaggcattgatacgtttcccgatttccatcctgatccctgacatttcctgtgtaaaacagatagagccgatcgtctttcgtgacagcgctgcccgagtagcagccgtttttatcaaaccaatcactcggagccagcgcaatctcttcccgcttccaattcacaacatcctgtgtcgtataatgcccccaaaattttgcgccgtgccccgtctgaaacggctgccactgaaagaatacatgatagctgcccttccaataaatcacgccattcgggtcattcagcagcccaaccggcggcatgatgtgaaaatgctggcggtgcggatcgctgttagcgatgggctcttttttctccacttcttcataagcccggcgacgaagctcctggtcatgtgctgtcattttttcctctcctcatcctcattaatcttcatgacaaatgctgcaatgaacgctgacactgccgcaatcgccatgccaatcagatagtgaatcaagttgctgacgccaaacggagccgcaatggcgatcatcggaattcccgttaacccgtaagcgttcgcagctacatgtgtaaagacgacatatgccccacccaatgcgcctccgatcatcgcagcgataaacggttttcggtagcgaagattgactccgaatatgacgggctcagtaatgccgagaaaagcggaaaatgctgccggaagcgcgatttcttttgtcttcgcctttttcgccataaagaagacggcaagacctgccccgccctgtgcgacattcgccattgaccagatcggcagtaagtagtttttgcctatatctgcaataagcccagcctcaatcgcatggaagctgtgatgaacacctgtcagcacgatgagtgaatacgtgcccccgaaaatcaaacctgccacaaaaccggcatggtcatacacataagttaaagcaaccgtaatcccggagccaagcgctcttcccagagggccaatcgcgataaaagcaacaaacccggtgacaattacagtaacaaaaggtgtaacaagcaagtctaccgcatgcggaaccacttttcttgtccatttctctaccttgctcattacataaaccgctagcagaacagggatgacagttccctgatagcctagaagcgcgatatcaaatccgaaaagatgcatataatcaggtgtcgcttcagccaaaccccatggattcaaaaggtttggatgaatcatgattccccaatgaccgctcccaagtacgggttgctgccaaattcttttgaagcgcttactccgattagaatcggcaagaaaatgaatgctgcacttgaaaacatatcaagcagctgaaaaactgcagaatccttgctcatccaatgaaacgcattgatcatacccagcaatcccattaacaggccgctggccacaatagccgggataattgggacaaaaatattagaaagcgttttcgcaaatctcgcagcgggattcagcttttcttttgccgcatcctgatgattgacgtgttcttcacgctcgatatcagcttctttagaaaaggcatcgaatactttattcacaaggcctgttccgaaaatgatctggtactggccagagctgctgaaagcccctttaacgccatcaagctcttctacttgtgcttgatctatctttgattcatctttcatcactaaacgcagtcttgttgcacaatgagccgcgctgataatattttctttccctccgagaagctcaatgaggcgttttgcagtctctttgtaatccatctatttctccccttttatttaaacaaaaaagacctaaaattcgccaacgaataaaggacacagcgatcctttttcatttacgcaaattttaggtcttgcctgctttaccagtcacaatcccgcttattcagattaagaatacgctttcatcataaatcatgacagcgttttcgtcaactatttttttagttaaatagtttgatataacatgtagacaaaaattcgtaaaaattaattgtgaaacacttcacaatatcgtgctatactatgctcaatcatgaaagaaagcaggaaaagacaatggaaactcaagcattacaaaaggttgaacagtatgctttgaaaaaacaaaacatattcgcttcaagcaaaatccgttatgtgcttcggtccattttggccagtatgtttattggttttggcattacagccgcaagcaaaacaggcagctatttctttatggctgattctccgtttgcctttccggcagccgctgtcactttcggggctgctattgtgctgattgcttacggaggcggggatttatttaccggcaacaccttttatttcacctataccgcgctccgaaaaaaaatccgttggcgcgacaccctgtacttgtggatgtcaagctatgccggcaatctaatcggcgccattctgtttgccatcctgatcagcgcgacaggactatttgaggagtcttctgtacattcctttttgattcatctggcggagcacaaaatggagccgccggcttccgaactgtttttcagaggattgctgtgcaattggcttgtgtgcctcgcctttttcattccaatgtctctcaaaggggaaggagcaaagctgtttgccatgatgcttttcgttttctgcttctttatttccggctttgaacacagcattgccaatatgtgcacattcgccatctcgcttttgattgagcaccctgatacagtgacactgatgggagcagtcagaaacttaatccccgttacgctcggcaatctgaccgcgggaatagttatgatgggctggatgtactacacactgaatcctgatcaataaaaaaacttccagagatcactccctgcaagtcaaagcggttattccgagagatcttgaagacgctggacatgcagcgtgatatagccggcctcggattccggcaaatgtaattgatattcatttttcaaaaactccgccagctccagcgcacattgataggcgaatgaatactttttttggatgaaataaagcatctcctcgtccatacgatggagcgcttcatttgattccaaccggctgaccgcgtatcgcaaatgcgtgacaaggcgttgataggaaatgctgttttcatccacctttcgattaaagtattgttctattttctctatcatttctttgatcatggtcgtatgcttcagcgctgaatacatgctctccgcatccatcttcgccgtatggatgtgaagggcaatataacccgcttcatcttcaggcagagacacgcccaatgtctcttttacatgtccgatcgcccacaggccgatctcatattcttttttatagagcgcctttatctcatgcagcaatttattctgcacaagcagcccattttgaatcctttcgatcgcaaaggacaaatggtcggaaagcgcgatatgaatgtgatcgctcagcggcgccgcgagctctccttccgcatagctgatgatatcctcagctatttctatatgctcctccggcagtgtttgcaggatttgtttgaacttttcattctcgtcgcgcacgacaaagatcttttccactttattcatagggatgagatcatttttctttttttgaaaagcgattcccggtcccatcacgattttttcctgatcatcctcttttattaaagccgcattgttgtttaatactttatagattttcaagaggttatctctcccgccaatttgcttttgactgggattttacctccttttgaccgccatgtaaagatgcgggcccgctctctcctgctttggcgattccttgaaggcttgcaaacatcttcttttataaagcgcggcggctttcgctttctgcttttcttcctcattcacagccatccgccactcataaaacgaaacgagtcctgcggcctgcacagccgcctttctttggtatgtacgctgagccgaatagaccgcggcagccgcagtttttctgtccggcgtcacccagttcatcaaaaagaccatccacacccgtaaagatacaagcaaacgtttcatagaaaaacatccctccacttctttttggcaggcagcctttttagcagcccgttttctcagccgcagcccgcaagaaaagacggccgatttcttttctcgcaaactagcggctctagcaaaactcatgactctatgatagaccgtggaaagagaattctttgtcacaatatgagtgaaaaaaccaactagtttttagaagttttgttgaaagctgaaagaattgaaatgaaaattggagaaccgctttgaaaactttatacacaagttatcccaaagataagaacaacttaatcacaagagatatccacatgtccacaaactctatctatattttgtatacgaacgtatattcctaactatatatatacacaggtttattcacttatacacagggttctgtgtataactccttcgttatacacaaacaaaatccaataaatggtccaaatgacacaaggatttttttgaattttcaagaaatatatactagatctttcacattttttctaaatacaaagggggaaacacattgaaaaaggggatcattcgctttctgcttgtcagtttcgtcttattttttgcgttatccacaggtattacgggcgtccaggcagctccggctttttcaaaaacgtcggctgatttggaaaaagccgaggtattcggtgatatcgacatgacgacaagcaaaaaaacaaccgttatagtggaattaaaagaaaaatccttggcagaagcgaaggaagcgggagaaagccaatcgaaaagcaagctgaaaaccgctcgcaccaaagcaaaaaataaagcaatcaaagcggtgaaaaacggaaaagtaaaccgggaatatgagcaggtattctcaggcttctctatgaagcttccagctaatgagattccaaaacttctcgcggtaaaagacgttaaggcggtgtacccgaacgtcacatataaaacagataatatgaaggataaagacgtcacaatctccgaagatgccgtatctccgcaaatggatgacagtgcgccttatatcggagcaaacgatgcatgggatttaggctacacaggaaaagggattaaggtggcgattattgacactggggttgaatacaatcacccagatctgaagaaaaactttggacaatataaaggatacgattttgtggacaatgattacgatccaaaagaaacaccaaccggcgatccgaggggcgaggcaactgaccatggcacacacgtagccggaactgtggctgcaaacggaacgattaaaggcgtagcgcctgatgccacacttcttgcttatcgtgtgttagggcctggcggaagcggcacaacggaaaacgtcatcgcgggcgtggaacgtgcagtgcaggacggggcagatgtgatgaacctgtctctcggaaactctttaaacaacccggactgggcgacaagcacagcgcttgactgggccatgtcagaaggcgttgtcgctgttacctcaaacggcaacagcggaccgaacggctggacagtcggatcgccgggcacatcaagagaagcgatttctgtcggtgcgactcagctgccgctcaatgaatacgccgtcactttcggctcctactcttcagcaaaagtgatgggctacaacaaagaggacgacgtcaaagcgctcaataacaaagaagttgagcttgtcgaagcgggaatcggcgaagcaaaggattttgaagggaaagacctgacaggcaaagtcgccgttgtcaaacgaggcagcattgcatttgtggataaagcggataacgctaaaaaagccggtgcaatcggcatggttgtgtataacaacctctctggagaaattgaagccaatgtgccaggcatgtctgtcccaacgattaagctttcattagaagacggcgaaaaactcgtcagcgccctgaaagctggtgagacaaaaacaacattcaagttgacggtctcaaaagcgctcggtgaacaagtcgctgatttctcatcacgcggccctgttatggatacgtggatgattaagcctgatatttccgcgccaggggtcaatatcgtgagcacgatcccaacacacgatcctgaccatccatacggctacggatcaaaacaaggaacaagcatggcatcgcctcatattgccggagcggttgccgttattaaacaagccaaaccaaagtggagcgttgaacagattaaagccgccatcatgaataccgctgtcactttaaaggatagcgatggggaagtatatccgcataacgctcaaggcgcaggcagcgcaagaatcatgaacgcaatcaaagccgattcgctcgtctcacctggaagctattcatacggcacgttcttgaaggaaaacggaaacgaaacaaaaaatgaaacgtttacgattgaaaatcaatcttccattagaaagtcatacacacttgaatactcatttaatggcagcggcatttccacatccggcacaagccgtgttgtgattccggcacatcaaaccgggaaagccactgcaaaagtaaaggtcaatacgaagaaaacaaaagctggcacctatgaaggaacggttatcgtcagagaaggcggaaaaacggtcgctaaggtacctacattgctgattgtgaaagagcccgattatccgagagtcacatctgtctctgtcagcgaagggtctgtacaaggtacctatcaaattgaaacctaccttcctgcgggagcggaagagctggcgttcctcgtctatgacagcaaccttgatttcgcaggccaagccggcatttataaaaaccaagataaaggttaccagtactttgactgggacggcacgattaatggcggaaccaaacttccggccggagagtattacttgctcgcatatgccgcgaacaaaggcaagtcaagccaggttttgaccgaagaacctttcactgttaaataagaaaaagtcctgccgattcggcagggctttttaaagatcagtcagcaaacgcctcgtgcaataatcgatacgatcggagcttatcttcaaaatgatgcgtgatggtcaccaccatgatttcctctgtttcatacgctttactcaaagctaacagccgctccttaacctgttctttcgtaccgacaatcattcgatttcgattatcagcaattcgtctctgttcataaggagaatacgtatttttccgaacagcttcatacgaaggaactccctctaaaggaataccctgctctcccgccaaaagtgtaaaatcaagcacagccccaagctcctctgccttctcctccgtgtcagcacaaagaacaaaaacagcaactgccgctcgaggcgtatctcctaacacagacggtttgaatcgcctcttatactgtctgacagtaccctctccgccctctccattgataaaatgggcaaacatatagccagcgccagattcagctgcgagaagcgcgctttctccagatgagccgagcagccacacatccggagccgttgaaatatgcggcgcagcggtcagattcggaaaacggtgtttgtcatccgccaaatcatgcaaatacatggtcagctccttaatttgctgcggatactgatcagcattgcgcttaccaccgtcattcagcgcccatgatgcaatcggcattcccccggtgctctgccaagccccaggtcaattcttcctggtgtcagcccctccagaacacgaaagttttcagctactttataagcactgtaatgcggcagcatgactcctcctgatccaacacggattcgctttgttttcgccgctatatgactgattagcacctcaggactggaccctgccagccgttttgaaaagtgatgctcagaaacccagaatctcttatatccaaggtcctcagcagcttgggcaagcgcaacggtttgctgtaaggccgtttctgcattgctgccctctgatactggagattgatctaatatacttaatgaaaccatccctaccacctcatcctcatcgtatcactgatcccctattttttctccaaagccgctcacactgcttatcagtgtcccctatcattcgccatttatttgtgaaagcatgtccctatttgtcggaatatgttacacgtgaaacataaaaacccctccagacggagaggtttgctttagtttttattaaagcccttttctttcacgtagtcatttaaatacgtacgcggcttttgcttcataaagttcagtatttgatcggaccacgtttcttcccgcttcccgtttgttctttctctatagtaatcagaaatggttttgtcatacgtattcatagtatgacggaaatcgtctgtgttcacattatacgtattctcatgataaacggcctgctttggcaatcttggttttttgccagaaaggttcgcaggatggcctactgccagtccgaaaagcgggagcacatggtcaggcgtttgcagcacctctgtcaccttgtccagttcattccgaatgccaccgatatagcaaatgccaagccccatggattcagcggcaatgctcatattttgcgctgccagcgccgcatcaatcaagctaaccataaacatttctgtattctcgagcagctcagaaatatgttcacctttttcctcagccagttgttgatggcggtacaaatccgcacaaaatacaaaaaagtgtccgttcttctcaacgtaaggctgattcccagcaagcacagacagctcacgttttttctcaggatcagaaaccccgataatcgaatatgcctgcacataactggatgtagacgcagcctgcgcacttttcactaatgtatcaatttcttcagctgtcaaaagctgatcagtaaaagaccggattgaccgatgattcaaaatggtttcgattgtgttattcatcacaaaaacctccttatcactttttatcatatccgaaaaaaagtgatctcaaaagtgaaatgctctgcacaaaaaaagacagcctctgtaaaggctgtctgcatatcaagaattaaaaagataacttctgtatttcgtcagctgcacacttgcattatatacaatcccaaatccgattagcgttgcaagcgtcgagcttccaccgtagctgacaaacagcagcggaatcccggtaacaggcataatcccgatgttcattccgatattctggaatgtgtggatgacaattaacgccgtatagccaacgcaaaagaaagaagcaaaacggttaaacggatgtattttgtctatcagaaccacaagcctgtagattaagaaaaagaacatgatgacaacaattgcacagcctataaagccaaagctttcacctaaaatggcgaagataaagtcggtctgtccttccggtacatacaccttcaaattgtgaacgccatttccgacaatgccgcctgagccgatagccataacagcctgatcaacctgccagctgctatttgcatcttcctgagttgttccatttgtatcagaaacccaggatgttaccctctttatttgatactcttgaatcccaactgatttagcagcatcaggaaaattaatcattactaacaagataagagaaataagtaagataccagaaccaccaatgattgcaatcagcttccagtttactccagacataaagatcatgacaatcacaataaacatacatatcccagctgtaccagcatcctgaagaaggataagtccgatcggcactaccgatacacctgcaatcttaagcaaaagatgcacatcatctctgagcgttcggatttttttagggcttgcttttgaaatcactgaggctaccatcatcatgagcccgattttcataaattcagagggctgtaacgttacagaaccaaactgaaaccagctttttgcgccgtttttcactggtgcaatagactcaggactgactctcaatatcaaaagaagcaaaatcccgaataaaaatacatataaactcagtttttcaagctgctccaaatcgaaatacagcagcaccgaaatggcaatagcccccaaagcataataaataatttgtttcgtccaggcattatctccatactgcccaaactgaccggcagcataaattgatactacgcttataataaaaaacacaccaaatataaaaatcaaatccccctggtaaaaggggctttgctgtttcttatatcgactcattctatcccgccttacattttcatcggaaaatcactaatgtttattatacatgaaccacgttcaagatgacacgtgaagctcgcttccttttatgttttttcagcatttgcggcgctttttcagctacacgaaatatgacgtatcataaaccgaaatgtttcgattgacacaaaacttttcaaatgaaaaaacgccataccaatagaatttgttaaaaaacgaatacgataatgtgttatgttcccaaataatgtgatacctcatatagaaatagttaaaaattcagagccccatgcccatacattctcctagcacattaaacaaaaaaaataagacgatagatccagtccatttctgcaaaaacacgtatcaatttctggaaaacatggtataataattgtaacagaatgttcaaaaaacaatcacaaaacagacacaactcagttcctctatttcatttttgtaaacgttatcacaaaatgaaaggagacgggtatgatggacatgttttttgcttacttactggttgccagcgcaacgcctctctttatttggcttgataacaaaaaagtcgcactctcagctattccgccaatcattttaatgtgggtattcttcttcttttacgcaacagaaagcctttctccacttggacacactctcatgattatcttgtttgccgttaacgtcattgtcgctcatatcgccgcatttatcatttacggccttccgtatcttcgcagaaagcgaagcagctgaagacagcaaaaaaccctcttccaatgaagagggtttttgtattattcgttatggcctgaatgctctgagtgttcagcgcctccaggaggatttccgtccatatggtcaccatggtgatagtgagccgcgaaaatccagatggatccaagtacgataacgatcgcgccaaagaatccgaacagcgtgtttccgacttggatcgtgccgttttcgctctctgtcatatgcatgaacatgagaagctgcagcgccgcctgaatgaaggcgaagccgaagataatccaaagttttgctgatgagctcaggtcagtatacactgcaacccatagagccagcagggtcaaaacgatagacaggataaaacctacaatgtgtttccatggaaagtgactgtgttcagcagatttgtttgccattttacagaccccccaatcccatgagatagacacctgtaaagatgaaaatccatacaacatctaagaagtgccagtacaagcttgagataaagattttagatgaagtttgcggagttaagccgcgtttcttcaactgaatcagaattcctgtgatccagaaaatcccgattgttacgtgagttccgtgagttccaagtaaaacaaagaatccagaccagaacgcacttgtactgagagccgctccttcatgtacatagtgaacaaactcgttgatctcgcatccgacgaagccggcaccgagaagaagagtgataattgtccaaatgactacgccttttaaacttccgcggcgcatttcatgaacagcgatcccgcaggtaaagctgctgatcagcagcaagaacgtcataatcattaccagattgacttcaaatagttcgtctggcaagacacctccagctgttctgtttttaagaacgaagaaggttgcaaatagtgttgagaacaacacaatttctgcccctaaaaagatccaaaacccgagaatattaagtctgccggtttcagattgatattccataggcgcgttagaattgccgtgttctgcatgttccataactcacgcctccttattcggaaatctttctttccgtctcttttatttcatcaacactaatgtagtagccgttgtcgtattcgaatgaacgcagaaccatgcagagcaggactccgatcaatccgactacgcccatccagtaccattcaaagacaagtccaaagcctgcaagaccgaaggcaacagacataaagaacggtctgcctgagttgcttggcatatggattttcttgaatttgctttcagggtataattcagttttttcttctttcatatgcaggaatgcatcttgagatttgacttcaggaagcaccgcaaagttgtaatgcggcggaatcgcagaagaagtcgcccaatcaagcgtacgtcccacaccccatgaatctccgctgatttcacgagtagagtaacggaagctgtagtagatgttatagcaaaggattaagaatcctacacccatcatgaaagctccgactgttgagataaagttcaatgttgtccagccgtcattcggtccgtatgtgtaaatacggcgaggcatgccttgaagccccaagaaatattgcgggaagaaacaaatattgaacccgatcataaagatccagaagaaccattttccaattctttcgttcagcttgtggccgaacatttttggataccagaaaataaatccggcgaaacaagcaaatacagtacccgcaatcagcacatagtggaagtgagatacaaggaagtacgtattatggtattgataatccgctgctgccatcgcaagcataacccctgtaaccccgccgataacgaagttaggaatgaacgcaagcgcccacagcataggtgttgtaaagctgattcggcctttatacattgtaaagagccagttaaagattttaaccccggttgggattgagattgccattgtcgtaattgagaagaatgagttaacggacgcactgttccccattgtgaagaagtggtgagtccaaactaagaaactcaatacagagatggcgataatagaaccaaccatcgctttgtaaccaaacaattgttttcttgcaaagcttgagatgatttctgagaaaataccaaacgccggaagaataacgatatatacttcaggatgtccccaaatccagaacaagttagcccaaagcatcggcataccgcctgcttccaatgtgaaaaagtgagcgccgaacaaacgatcaaatgataaaagtgctaatgctactgtaagtacagggaacgcaaacacgataataaccattgtgatcagtgttgtccatgtgaacatcggcatacgcattaatgtcatgccttttgttctcatttttaagattgttaccataaagttaatccctgtcatcagggtaccgataccggcaatctgaagtccgaggaggtagtagttctcacccggcccagggctcatgtcgttacttgcaagcggcatataactcgtccagcctgcgttcggagaacctccgataacgaaagaaatattgaaaagcatcgcccctacaaagaacgtccagaagctcaggttgttcaagtaagggaacgcaacgtcgcgggcaccgatttgaagaggcacaacaacgttgataagaccgattaagaacggcatcgccatgaagatgatcatgattgtaccgtgagttgtaaaaatttcattatagtggtttgagtctaaaaaactgttattcggaagcgctagctgggcacgcatcatcagaccgtcgacaccgccgcggaataacataattacagcagatataatatacatgattccgagttttttatggtcaacagtagttatccattcagaccacagccatttccactttttgaagtaagtcagaacaaaaataatggcaatggttgaaagcgcaatggaaacttgtgcgcccagaattaatgggtcaccagttacgaaaaattcgtcccatttgaatttcatgcaggcttcctcctttcctgatcaatatcattcttctgtatcatcagacttcttaaattcgtttttctttacgttttcaaacggatctgttttagagtgcggtgaaacggcttgatagccaaggcgtttgcgcgcctccatcgcgtactcagcgtcttgtccgtgatcaacgtatttcaagtgagtagaagagaacgttaattcgtccacattttcaggaagcatcaattcatcatacttctcttttgtcagcttaggagcctcgttctgagtctttttcacccagctgttaaagtctttttctgtgactgcattcacatcaaactcttggtctgcaaaatgttcacctgtgaagttcgcgttgcggccttcgtaagtacccactttgtcagcctgtaagtattgatccatcagcattcctgccatcgcatatttttgccctccaagctgaggaatccatagcgaagccattgaatctgcagatgagattttgaacaagatcgggcggtcgacaggaatgtttaagtagttgaccgtttcaatatcctgttcagggtagctaaatacccatttccagtctaccgaagtagcataaacaacaagaggctctttgtcttttgttgcttcaggagctttttctaacgaatatatcgtctgtactgttggcacagaaagtgcaatgacgattaaaattgggatcactgtccagactacttctaaaaacgtgttaccgtgaatttctgggttataagatccattatctttgcctttacggtcgcggtattttactaaaataatggtaaatagaacaaagacgaccccgacgataaacagcataaatccgatagataacaggattaaatcactttgctgttcagctacaggtcctttcggatctagtactgaagcattgctgcatcccccaaggacgaaaaccacagttaacagcgctaatacaagcaacggttttaatgctctgaacaagaagatcaccatccttcctattgatgtaataaatctgaagtgcatacttcctcaaaatcttttctctactttgttatgctatcaaaaacttcacttattagctttatttttttataaacttcatcccattttcgcttaaatgtcataaaatcgacaaaaattgctccaactttattcacatctatcgcttaatatgaaaagtttctagttatttccgcatataaagtaaagaaagatgatgaagaactaattctgacaaattaaggtttaccacaataaaaaacttaggtcaatcaaaaatttcattttgttaaactttctagataggaattattttttcctcgtctagcatcttttcacacggttaccattttaacgcatcaaatattgaaagaaaaggcgcaatgaagagccaatatgctctgaattgtccgcatttttttatgagagcatccagttgtttatcttatacaaaaaagaggaatgatataagcaaataaataaaaaataggatgtgttgcatgatgagttttcttatttcacttatcgtcgctattattatcggatggcttggaagcctgtttgtaaaaggagatatgcccggaggaattatcgggtctatgatcgcaggtcttataggcgcctggatcggacacgggctgcttggaacatgggggccgcacctagccggatttgccattattccagcggtaatcggcgcagccattgttgtctttctagtaagcctgttaaccagaaaaagaggataaaagcagcagcacccgaagcgtcagcgctttgggtgtttgttttgcgataaaaatcgaaaaagcctcaaccctagcggttgaggcttttgactggtttggcgcccaactgatcgatgaaccttctgaaggcctgttttcccactgctgtctgcttaaatacaccggcgtgttcaagaatgcgagcgaatacatgtcccagctcttcttttatgactagatctgcattctcttttgttatggttcttttttccatcatccgaagagcccattcactatgctttgccgtgagcggattttgttctaaggctgttttcggatcagcagaacatagcgccgctgccgtttctttcatttcctcctgtaagcggccaggcaatatcgccaatcccatgacctcaatcaggccgatattttcttttttaatatggtggacttcttgatgaggatgaaatattcctaatggatgctcctcatccgtccggttgttcctcagtacgatatcgagttcgtacaattctcccctgcgccgcgcaatcggtgtgaccgtattatggggcgtatcgcctgtataggcggcaatgccggctttttcatcggaatacgtctgccacgtgcggaagatatggtcagcagcttcggcgacatgacccggttcgtctccttggagcctgagcacagacatcggccacttcactaagcccagcgacacgccgggataatcatttaattcataaacgtcttccgcttctgcacgtgccattggaaaatcatgcgcgccgccttggaaatgatcatggcttaggatgctgccgccgacaatcggcagatccgcgtttgaaccgataaaataatgcggatattggccaagaaatgacagcagcctttcaaatgtttttttgctgatctccatcggttcatgttcaccttttaagacaatgcagtgctccggataatagacatatggcgagaattgcaggaaccattgttcgtcctcaagaatgaccggaatgattctgtgattttgccgggctggatgattcacgcttccctcgaagccgacattttctttacacagcaaacacatcggataatttgtctgttcctgctcttttgcagccgcaatcgctttcgggtccttttcaggctttgataggttaatggtcatttccagctcgccatattcggtcggcaccgtccaatgaacatttttggcaattctgtcagtccgtatataatagacatcctctgaatattgatagaattcctttgtcgcctgttttgggccgtataatgcttttgtctcttcaaatttgcgaatgacctcggacggggcaggcacaaaacagcccatcagctttgcgctgagcaggtcacggtacgtatctgtatccgcttccattcggccggtttccgcagcccatttatagatgggagcgagcaagtccggcaggctttgtgactgcttgatgctggtgctggagatcggctcgggatgtgtgatgcccagcgcttcataaagacggtttctcgtatattcccgatcccagatcgaaatcaattttcgttccaggccatactcaagcagctgttccagatgttcaataatactcatatgtcactccccctttagttctctcgctccctctccgatatccgcgacataaaagtccgctcggagccctgttttttcttgatatctgtctccaaccttctgaataaaatcatcaacgaactcatcttttacaatgctgatggtgcagccgccaaagcctgctcccgtcattcttgatccaattacaccttcgtgatcccatgccgcaaacacaagctcatcaagttcagggcatgttacttcatagtcatccttcaatgaaaggtgggattccttcattaactgcccgatttcatctatattgttctctttgaacatatgggccgtcttaatagcacgatgattttcgtatacagcgtgctttgcccggcgtctgttcgtttcattttggatcaggctggaatgcgcatcgaaatcagaaggcttgatgtcgcccagtgcggcaatatcgaggccttttttcagatcaagcaatgcatcattgcattcttggcgtctcgtattatagctggagtcagccaatgtcctttttttgttcgtgttcgcgatgaccagcgcgaggcctgagacattgagtttgctatattcatagtcaagcgtgtcacagttcagcagcatcgcatgatgttttttccccattccaattgcaaattggtccataattccgcaattgacgccgataaaatggttttccgcatgctgcgccattttcacaagctctagcgcatctacttcaggatgaaaatagctttggagcacgacccccatcagcagttcaatagaagcggaagacgacagccccgccccgtttggaatattccctgaaaatacaatgtcaaagccatggggaactgcatatcccctctgttgaaattcataaatcacgccttttgggtagttcgcccagtcgtcttctttttgatagcgaatgtcgtcaaggctgcattccttgatccccgcgtctttaaagttgtctgaatacatccggacaaccccgtcttttctttctgcaacagcagcatatgtacccattgtcagcgcgcacggaaagacatgcccgccgttatagtctgtatgttctccaatcagattcactcttccaggtgcgaaaaaaaaccgtaacccctctttttctccgaatacacttgcaaatatcccctttagctcttcccgcatgtgcaatcacctttctggtttttattttttattccccttatttctccatagaaaacggcagatcatatgctgctgtcctctgtcataccccttcttcttttgtttttttaaagacgagccatttgctcgcaacatagttgacgacaacaatgacagcgttgtcgagtattttggccaaggtttcatttgtattgaactggctgacaagaatgatcatcatgcctaaatctatgccgagagacaggacccgaacgctgaaaaaagcagtgagctctttcagcaggctctgcagatcatgtgttttttgctgaaacacatataatttatttgttatgtaagcaaacagcacggacaaaatccaagcggcgacagtggcggctttgtaatccatattcatgatctctaccaatatataaaagctggcgatattcacaatggttgtgaaaacccccataatgatatacataattatttctctatacttcactgatgttcctcgctttctgaaaaacttttcaaaattcttggcgtctcgtgctctctgtctaaagtgaaaaataccgagagtgcgtctaaaaagctgcggaaggtggctggctggcccaatacatatgattgtttgatgattccgtcgaggactgcacatattattttagccgtatattcaggatcaatacaggcgtcaatcagctttctctccttcagccacttaatatataacacattttcttccacccacaattcgtacagccggacataggccttgcatttctttaagactttatacgtcggcatgttcatggcaaacgaggtgatgtcccacgatggcttatttatgtaataggaataaagcagttctgcagcgtgttttgcagcctcgtccaatgtcagcgatttcactgactcccgctccatttgatcaagataccctataatgatcttttttttcatctgacgtttttctagaagatacagcagaaaatcgtccttgctgacaaaatgaacataaaatgctcctttgctgtacccggcggctctgctgatatcttctacagaaaccggatcatacgctcggtcaatcaacaaattcacgccagcgtctataaaactttcaaatgttgcttctcttttaatttgaaatttgttttttttcatatttttctcctggcggtaatgattacccttatcttacaccggatcaatctttagcggtatttatttctttgaacggttatgctattcggtttcccaggggtcatttttaataggctaaatgatttattttcatttacatactatccagtcagtatttaattgtttattattataaataaggtccattggttatattagtcatttttttagggaataggtaggtggtttttccttcagtttgtgaacaccgagcaactatgtgtgaaatttgttgtactcgcctcatcatcgcgctggcttgtcttttattgcccgcatgttgcaggaaaacattttatacaattggaggttactatgaaaactcatgttaaaaaagatttggacaaagattggcatatgttaattcaagaagctagatccattggattaggcattcatgatgtgaggcagtttttagaatctgagacagcatcgagaaagaaaaaccacaaaaaaacgtccggcaagactagtccgaacaggcggatctatttacctctggcttttctatcacctgatctgagttttcaccatatcctctattcaaaagcaaatcgctgcgctgagcttgaggacaaacggtgtgtcagctaactacgacagacagccggtgatgcgatcacctcttggcacatgcattgtcataaagaggtgatgcgaacatgataaccgtgctctggtaaacagcagctttgctgagaacaagctgcattcggtgaggttttgaaagcaaactcgtttatacacggccgagcttgaaaaccttcgcctgtctttagaccactgtgttcacctcttcacgacctccttcttttttcatcctccagatattgttcaacgcataaatcggactttcagtacatacctattggtgtacctttttgcttacgtttagcgaataaaaggaggaaagccatgtacaaagctgattataaacagattgctgcaacgccgtcttttcaagcttttttaaagcagaaacgcgcttttattgttccttctgcgattttcttttttgtcttttatttttcactccctgttttgacatcttatttcacctttttgaatgcaccggccattggagctgtttcatgggcttggctgttcgccatcgcccaattcgctatgacctggatactgagtactgtgtattcccggagagccgctcatttcgatcggtatgtaagcgctttaaaagaggatctgaagggtgaacagacatgaatatgactgcttttttattgtttttggcgattgttggcctgacgcttattatcacgtattttgccgcgaagcggacgaaaacgacgagtgagttttatacggcgggcggcgggctcaccggcgttcagaatggactggcaattgccggtgactacatgtctgccgcctcgtttctcgggattgccggaatgattgcgttatatggatttgatggcttcttttacagcatcggttttctggtggcttatctcgttgtcttgtacatcgtggcggagccgcttcggaatcttggaaagtacacgatggcagacatgattgccgctcgctttaaagaaaagaaaatccgcggtgtcgcggctctcaataccattgccatctctactttttatatgatcgctcagctcgtgggggcgggagcgctgatcaaactgcttctagggctggattataccgcggctgtcctcatcgtcggagtgctgatgaccatttatgtcgtgtttggcggcatgatcgcgacaagctgggttcaaattattaaagccgttttgctgatggccggtacactcgtgatttcgattatcgtgttttcgaaattcggctttagccttaataccatgtttgaacagatgaaaacggctactccgcttggcgctgattttttgaatcccggaaataaatacaaggtgccgcttgagaccttgtcgttaaacttggcactcgtgctgggaaccgccgggcttccgcatatattgatccggttttataccgttaaggatgccaagacggcccgtacatccgttgtgtcagcgacatggattatcggtgtgttttacattatgacggtgtttctcggctttggtgccgcggcatttgtcggttttgacgcgattacaggggctgatcaagcgggaaatatggcggctccgcttttagcaaaagcgctcggaggagactttctgttcgcgtttgtatcagccatcgcctttgccaccattttggctgtcgtgacagggttggtgctgtctgccgcctcagcatttgcccatgatatttacagccagatcatcagaaagggagaagcaactgaaaaagaacaaatgaaagcggccagatgggcttctgtcgccgtgtcagtactctcgattctccttgcgatttttgcacaatccttaaatgtggcgttccttgttgcactcgcgtttgcagtagccgccagcgcaaaccttccgctgattgtgtttacagtcttctggaaacgattcaatgcctcaggcgctttatggggcagcctgacaggcctgatcagcgcgcttgtgctggtatcgatgagccctagtgtgtgggacccggccggaggtgctatttttaccggtgatccgctcattccgctgtctaatccaggaattatttccatcccgctcggctttctcggcgcgtggctcggaacggtgttgtcgtctgataaaacaattgatgaagatacgtttgcagaaatacaggtgaaggcgcatactggcgtccatatggaacaggaataaaaaaagctctctttatagagagctttttccttgtcttttcttctgttcttcagaaatcgctttttcaaatacatccttgccggcagcacctggaatgacagtgtcgccaataataaaggttggaacggctgtgatgtcagcctcttcataagcgtgcttcaaggcttggcgctgcacgtcctgatatgttcttgtttccagtgctgatttgaatgatgcaccgtctaatcccacttcctcggcgagcttcgtcaagatgtcaatatcgccaatattttggccctcctggaaaaacgcctgaaagacacaggtgttgtattcatgtcctttattgtattccttcgcaaaatggaagccttcaaacgcaaggtctgtatacggatgaggcgagacgtttggaaaattgatctcgactcctaatttctccgccattggctgaatagatgtctgccacatgtactgtttggaaggatcattgaccggatcaagctgaggagatgggcttgggcgcagttcaaacggcatccactcgacttcaacatcctttccttttatcgcttcttcaaaagcggcttttccaacaaaacaaaatgggcagacgtaatctgaataaactttaatgtgtactgtcatgataatctcctttcgtataaattgattttaaactgtaacaattaaagttacaactgttttttaaataaagaagccgattaaggcttctttcagattgatgacaaaatcctaaaaagttttaggattttgtcatcctttcagcgtgattgaaaacccttgaagtctaggaaagccgagcattggagcggagcgaatgctctaattcgtgagcaccaacgcacaggcttgacaacgaatgcgagggtttgtcgacacgctgaaagaagcctgtaaaggcttcttttatgattccagcaaacgctgggcaatatattctccttttttgcagccgcctgggcatgcgtataaagcagaaccgattgtttgtgtatattcgtttaacgcatcctttgctgaaagagccttcagcatcgggataaactgattgtcgggatttttttgaaaactgataaacaggagacctgcatccatatagccggttttcggatcaagtccctctgtgtaagagaaagctcttcgcaaaatttgttttcccgtagatttcgctagactgacgtgtgaattagacggaatttgattcagcttcacgggatctgtttcctttttctgcccaaaaggcgcccctgagctttttctgcggccgaaggtatcctcttggtccttgagggaagagcggtcccatatctcaaggaacattttaattttccggaaagccatataggtgccgcccgtcatccagtcaggctcaccggactgaacccacacgatcgagttcatcaagctgtcatccttcgtgctctggttgcctgttccatctttaaacccgaacaggttgcgcggtgtttcaccattttttccaccgcttagaaagcctttgttcacaaaacggacctcacaagtgccgaccgcttgatttagcaggttacgcagcgcgtgaaacgccacttgctcatcgtctgcacatacttgaatgcagatgtccccgcctccctgcttttcatccaggttgtcattgggcatcgctggaagagcggctaggtgcttcggttttttgcttttcagtccgaagcggtcctttccgtctttttcaaaaaagccaggcccgaatccgaatgtgaccgttaagttggaagggataaatcagcagactcacctgtatcctgcggcggcagatactgatttctctgctccgctgacattttctttccagatgtcagcatctgtgtgagacttgtccagtttctaaataacgtaatgatgtcgcttttgtcttttgctgttacatccagtgcagcaaaatagacatacgtttgatgggcagttgtgattccggcctgatgctttccgtaaaacggaacaacctgatcatcctctttttcatcctttttcgatggcttagacgcggtctgaacaagcggagcgagtccgccgagtccgctggccccgatcgcaacggctgcccccgccattgccccccattttaaaatgtcccgtctgtgaatttgttctggctttttttgttcatcgctcatgctgttacaaaactccttttatagcacattcgcaatcttcgacatggtttcagaaagagtcgtcagctttgtgctcagctctctgatttgcttttcacttaatttatcataagacgtataggactgatcatttgttttgtattttgccattaaaacttcaaattcgccgaactccgtatccagtttttccgtcaagtcggagtgatcttttacaagcgcgcttttcactgtttgataaacggcttcggagccttccacatttgccataaggtcaactaaatcaattcgtgagtagcgctcttcttctcccgtgattttcgaaattccggcttcgttcagaagctccatcgcgcctgcaacaatttgttcaggtgttaatttcagtgattgaattgaaccgtcaagctcttttacatccttgagaagctggtcagctgttgccttttccccggaaatatcttgatccttccaaatggccttctcaagcttatggaagcctgtccatttgtctccttcttcaacatcgttttctcgtgcgtcaattttcggatcaagatctccgaggctttcagcgatcggttcgattcgctcgtaataaacacgcgctttcgcatataacgttttggacttttcgatatcgccggatttcacagcacccgtaaatgcttcagtcgctttgacaagctggtcactctgctctttgacatagcctttatactcatccgctgcttttgccagctgatcgctagcctttttgccgctcttcttcgcttctgtcaggtcttctaaggatgctttcaatgactcggattctgtcttgatttttcctgcatccggtttgtctttttgcgcttctgtgtagattggctgaagatgcttttcgatttctgtatattcgaatggatagtcgctgcgaatatcgttttcaaaggaaagccagtagctgtttaactctttccccttcttttcaatctctttttggtctcctttttccactgagtcattcagcttagaaatgatggtttccattttatttacggatgcggtgatttctttagtgaccccgcttttttcagatgaagctttttctttagttgaagatgtgtcattggctccgcagcctgcgcacagcgcaaggatgcatccggctgatacagcgatttttgtgaaattcattttgtcagttcctttccgtttgtaaaatgttttgccgcttctgaaacaagcgcaatcagtaaaaagagtaaaatcaacatttgcggaatcgtgctgtacacagacggataaattcctagcaccgatacagacggcagccagctttctgcatcagacggaagaatgcccgccagttgaaggctgtgaacgccggttccgagaaatttcacgcacatatacaggacaaccgccattgatagaagaaaaaacggcttcaatggaatgcgcattccgagcttgatcatcagaacaccgacgatgacgagaacgataagccctgcggcagttccgccgatcagttcagtgagcgggagcttcccgacaagcccgatgaaaaagatgaccgtttcgagaccttctcttacaactgccagaaatgcaatgagcgcaaaggaaagcaggcttcgtttttttagtgcctgtgacttctggatattgattttttctctccatttatccattgaggcgtttctgtgcagccacaccccgacatacaaaagcatgacagcggacagtacgccggtaacgccgccaagcaagaaattgttttctccgaatacactggaggagaacagaaccgtgataccgatgccggctgctaaggaaacagccatgccggcggacgccccgccccagatccatgtcgaggaacgcgtaacccgcgctttttttgtcatggttaatagcgctccgatgacaaggagggcctccattccttcacgaaccgggatcagcgccgcatcccaccagctgtagctgcttgaagcgatcggctcgagcaattgaattatttcgtcaatttgctttgataccttttcaggatggctgccgatctccgccttcatcagcgccagattttcctccgatgtcgtataagcttctttcgattgggaaacgacgtctccctcaacagcgagccacgatgtaactaaattgtcgattgcggatgacgcttcatccatttgttttttttctatgaactgttttgtgtctttcaagctttgtatataggctgttaaggacgcccttgattgacctgaggatgtctttttcagcacgacagcctgctggtaggtttctaaatgagacgcaagctcttcaagctgtgttttgagcttgcctgcgtcttgattgataaaagaaagagaaatcatcgcgatatttgcgtccatttcactgtgagaagaaaggttttctttcttaatagaaggttcttcttttttccacttcgctttgaaggtgtcaaacgtttgttgtgccgaatccatatccccgtcttttacggatttgatcatttgcttgtttaattgaattaatgcggcgatcggatcatcttccgcatgtgccgcagaaccgaaaaccatcaacaagctgaatagaataagtgccagcccccgagccatcatgttcctcctataattgaaaatgattatcattgtataacataatcatagccagttcctgtcctttgtcaattaaaatttgaaggtctgaaaaccttgatggacagcaaaaaagctgtccttttacagaacagccctttgaaggaaaatgaacgattatcttcctgttttatacgtttgaatttcctcacgaaacttgcgtgcagcactctcaggatcctccgcctgactaatggcgctgatcatactgacaccatcggcccccgcttggataacaggtgcggcattatctattgtgattccgccgatgccgacaattggaatgctgatgccttggcggcgcactgcttcgataagagatacaccctgtaccgctctcgtatcttttttcgtttcagtcggatagatcggcccaagcccgacataatccgctccgtcttcttcggcttgcttcacctcagacatcgtatgggcagaaacgccgagaatcatatcacctatggcagctcttacctctttcgcatttgcgtcttcctggccgatgtggataccgtcagctttcagattcagagccaattccacatcatcattgacaatgaacggaacaccagcttcacggcaagctgcctgcgctttttcagcaaatttaatccgagcctctcctgtcagcgcatccccgcctttttcacggaactggtacagggtggcaccgccttttaacgctttttgtacaactgtaacaggatcggctttcgtattgtttgaccccataatgaagtatacagataataactctttcatcatttcccgagaaatacgagtcatgagacagtcaccctttctatagtcgtccattcttggacgtcttgttcagtaacagttgaaagcttgttcagcaattcaatctgaaagcttccagggcctttgtcagccgtctgctgtgcggcaagctgagcggcgaccccatacgaagaaatggccgcaatagcagcaaacaatggattttcttccacagcgcaaaacgcaccgacgacggaagtcagcaggcaaccggcgcctgtcacttttgtcagcagcttgtggccgttatgaagggtgtatacatgtgacgtgtcggctatgacatcaacttcaccagttatcgcaatgaccgtgtttagcttttgtgccgcctgctgagccagccggatgatgtcgcctccgccttcacccgcatcaacacctttgatcagccaatcggtcacgccgacggtatgggcaatttccgccgcatttcctctgattgcagcaaggcgcacctcacgaatgatgtcacgtgccgattcagtgcggaacggtgttgctccggcaccgacaggatcaagaatgacgggaacgccatgttcattagctgatttccccgcgatgatcatcgcttcgactgactccttgctcagcgttccgatatttaaaacgagtgcacccgcaatcttcgccatatcggcgacctcttctttcgcgtatgccataacgggcgatgcgccgagcgcgagcaggccgtttgctgtgaaattcgttacgacattgttggttatgctatgcaccagtgggctatgccggcggacagccgtaagacattttgctgctgattgtgcatccatgtttgcatcatcctttactatcttttttcgggtcccataaatacgatttcgtatgttcgagccaagctctggcggcaaacgacaagtacctgtcctttctccaaataatggcgaggtgccaagggatgaccggatcgacaagcggaatgactttcactttttccgggtcaaggccgcggcagatccgttccggcaaaagcccgatcccaaggttggcggataccatctcactaataaaatcccattgtgatgtttcataaatgatatggggccggaacccagccttgatacattccgtcataattcggttgtgcaggacaaaatcctccctgaagaaaataaaaggctcgtccttcaactcacgtagctgacattctttctcatcagccagcctgtgggaagggtgaacgacaagcattaaggtttcttttacgattgtaaacgaatgaaagatatcttcgtttgcgggaaggaccacaacgccgatatcaagagagccgtccccgacaccttcttggacttttatagaaccgtcttcgactagctgaaaggtgacattcggatagttttcacggaaatcgccgagcactctggggaaaaccccgatccgatcatcggcggcagtccaatccgtacgtgccctttcttgacttccataatatcatttaattctgacgtcaggttttgaaatgatttaatgatttcctgcgcctgcacatacatgctatgaccggcatcagtcagttccacctgcctgccgtttcggtaaaacagttcaattccgagctcttcttctaaatttttgatcatttttgatatcgtcggctgagaaacataaagggattgggaagccttcgtaaaactttttaaacgggcgacttccaagaaatatgttaaatggcggatatccatgcgcttcaccctttctatagacaaaaggaatacttcttattcttaatatatattttacctatagagagaccttatgtacaataagtatataagggaggcatcaatatgaaaaaactgttgctaaccgttattcaaatcgctctgttatttatatttgctcggctgattaattgggtgacagcccttcttcatataaatattcccggcagtataatagggattgtgattcttttcacattattgcactttaacattatcaagcttgaatggatcgagcttggtgcagcgtggcttctcgggagctgcttttattttttatcccgtctgccgtcggagtgattgaatacggagacattatgtcgaaatttggtgtcagcattctgcttgttgtcatcatcagcacgtttgtcgtgatggtgtctacaggaacgcttacacaactcatcgcaaagagaaaggagaaaaagcatacgtgttcatcggaattgtaagtttgtttttaacggttttggtgtatttaggagcaaaaaaggtatatcaacgctttccgcgtgtttatacgtcgccgctattggtgacgcccgctgtgttagtcggtctgctgctgctggtgaatgtcccgtacgagtcctataatctcggcggcggattgctgaccgatatgctacagccggccaccgtggcattcgcgatcccgttatataaatatttccctgttttaaagaaatacgcagtggaaattattttgaatgtggccgtcggttcatgcatcgcgattatttctaccgctcttattgcgaaatggcttcacctcggcaccggcttaattgacagcctcgtcccaagatcagtgacaacgccgatcgcgatgaacgtatctgaaatgatcggcggtatgcctgccgtcacagccgtgtttgtgattttaaccgctttgctcggcacagtgatcggcccgatggtcatccgttatttccgcattgataacgaaattgcgcggggcgtgctgctcggcacaagcgcacacggagcgggaacgtctaaagcatttgagctcagctctgtgtccggcacgatttccagtgtgtcgatgatcttagctgcgattatgacgctttgcgctgcaccatttttgctttcatttatgtaaaaaaactgtcctctcgagggcagttttttttatgtgcttccccttattgaaaagctggcgaattccaatataatgtatttgtggataccaaaggaggcaccctgatgcacaacttgcaggtgaggcggcattatgccgcgttaaaaggattttatttgtttgcttttctcggtacgggcagcataattcccttactcagtatgtatttaacgaaggaacagcatttaagtggatcacaggtcggcttgatcatgtcactgggcccgattgtgatgattttctttcagccgttttggggcatgctgagcgactatacgcaaaaaacgaaaggcctgctggcggtttgcacatcaatcacaggcatcattggattagcctatattgcatttgacagtttccctctgtttattttgattgcggcctgttttgcagcctttcaaagcacgattattccactttcggacagcatttcactaaggtacacacaagaaacaaacggcaactacggcggaatccgcctgtttggttctctcggcttcggcgtcgcggtgtttgccatgggacaggtaacgaaccagctgtaccccattcacgtgatctttatctttggctgtgcctttctgtgcattgctgccttattggcttcacaaatgcccggccagcagaaaacaaaaacaaaggtcaatatccgcaaaggattccgggagcttatcagcaacaaaaccttcctcatctttatgatcatcacctttacgacatttgctccaaacttagcgaacaatacgtatttcagtctttttctggacaaaagcggcgcgtcactttccgctatcggcattttatttttcatcggcgtgatttcagaaattccatttatgagattcgcccaaacatttatagataaaatggggctgctcaacgtcattatgctgtcaggcggagtctcattattcaggtgggcgctctatttcacggcgccttcactatggatcatttatgcgacggtctttcttcagggagtggccatcggtttatttatcccggcggcgcttcaatatgtgaaaaagattaccccaagacacgttgaagcgacggcgctgactatgtacgccgccattggcaacgggttcggcaactggttctgcacatttgcaggcgggtacatttttgactacgtgtcgattttcgcagtctacttgctttttggcattctgagcatagcaggctttggcctgacattatatttaatgaaggctgaaaaaaaacaaacatacacttcatcagccggctgttacttttaaaccataatgactataatgaacaaaagaaaggatgtgcgttatgaacgggcaagagcgaaacagcatttcgaaagggttgcaggttgatattgtattgaaagcagatcaaaaaacaggaaaactgacgagagggacagtgaaggatattttgacgaaatcaagctttcatccgcatggcattaaagtccggcttgaagatggccgcatcggccgcgtccagcagatcatttctacataaaaaaagctgcccctgaacagggcagctttttcattattttttctgcagaaggaccactttcaggtagttgccttccggaaatgccgaaatcgttttgaaatcctccggcagcgtaaattcctcaatgatggtgtagcgttcgtttgtttctttaaatgcggcatcgataaagcctttgaatttcttcatgccaaaggcgctgctgtttgtagaggcaacaatgacacccttgtcagcagtgatggcgatcgtttccttcagcaggtttttataatccttggccgcgctgaaggtgcgtttttttgtgcgcgcaaaggaaggcggatcgagaataatcagatcaaagcgcaaatccttttttgcagcatatgaaaaatagttaaacacgtccatcactttaatgtcgtgcgcttcgtaatccagcttgttcacgctgaattgctcgatcgttttggccaggcttcggtttgccacgtcaacgcttgttgttttctccgctccgccaagcgccgctgccacggagaatgcacccgtataagaaaacgtatttaaaacggttttcccttttgcatagcggtctctgatcgccttgcgcacatgtctctgatccaaaaagatgcccgtcatggcgccttcattcagatccaccgcatattgaatgccattctcctggatgatgatcgggaactcgcctcttctccctttcacgaagtcatcatcttcaacgtattgtccagctgtgtcgaagcgtttcttctcgtaaatcgctttataatcaagatccatctcatccaatgcggaaatcagcatgtctttaaaggtgtaaatccccttgctgtaccattgaatcagcaggtagccgtcataatagtcgatggtgacgcccccgacaccgtcgccctcaccgttgaacaggcggaaagctgttgtatcttgagcctcaaatagtttggcgcgcgcttgggccgcttttgttaatttggtgagaaaaaatgcctggtcaacccgttcatgtttattgcgggtaagcgtccagccgacccctttgttttgcaggccgtaatagccccgcgcgagaaactcgccgctctcagacacgatatcaacgaggtctccttctttcatgtgccccgcactccctgcgagagcttctttttcaataaggggatagcctttttttattttggcagcgtgtgctttttttagggtgagtagcttcatatatgtcgtcctctttccgtttgctttctcttatggtaccacaaaacgccaagatgtctgcattgacagaaaggaaaggtttttctacgatagacaaaaagagttacgaggaggagcagcatggcaaaacgaattgaccatacaggcatcatggtaagagatattaacgcgtccatcacattttatgaagaggtactaggcatgaaattgaaggatcgcatcacacatacgaacggtgtaatcgagcttgcttttctcggctttgaagacggcccggaaacagaaatcgaactgattcaaggctacagcagcgatcttcccgctgaaggaaaagtgcaccacattgccctgctgactgatgacatcgcggctgaatatactaaagcggaaaaaatgaacgcaaaatttatcgacgaggagatcacaacacttccaaacggataccgttatttctatatcgaaggccctgacggtgagtggattgagttctttcagcgataaaaataaagaacgtacattttgtgatgtacgttcttttttatctataccaactgatacacgttgactcatcgcaaatcatggcttcccagcccatacgttcaaccaattcattgatgtttttatcttttgctaagaagacattaatgaatgagtcatatacactcataaacacaaagtccattttctcatcagtcaaaacgagctctgctgcggcttcatcaagaaccgtccgcaagttggcctcagttatgtccaaaacgccacggttttccacaatcggttctgcgtaataaaaccgattggatccgttcgcacctaaaacctttaccaaactcggaatatgaaaatttgaaatatgatcctcactgggataatagaggtctccatttatgttttcatgtaacacctcagcaattcctctctcgcgaactcgtcccttaaagcgcctatcgacgtcattaaagccagcaccagctcagcatgtgtttgaaagccgcaagaagacataaccttcttccaggaaacagccttgcctttttctctgatttcatcatcgtttggataaatatgctcgtaatcatgttttctttttgcattctcccatccttcaggcatttggataaaaggagaaaaaataagagcagcagatgagtattcaacaggtatttgttgtaagatcggtgattcgtcatctaaccatatataatctagcatgcgcacctcctttacatattctaacattctctttcgtttaaaaggagatgatcagccctatgacaggctggtcatctatcacatcacatttttatccccagattcaaccgcactctcttcccgccatttttgatgatcccatattctgaaaaacggatagtagatagcacaggtgatcagcaggtttaccagctgcataacggcgcccgacacctttccgcctgtcgccaggtagcctgatatgagcggcggcatcgtccacggcaccgcgattccggccggtcttgccaccagcccggtgctcatgccgatataagtcgccgtaatcgtgaggagcggtgcgatgataaatgggacaataaggagcggattcatgacaatcggcatgccgaaaatgatcggctcgttgatattaaaaagcgcgggcccaatccctaatcggccaagctgcttcatttgtttgctgcgagatcggacaagcatcgtcaggacaagcgccagtgtcgctccgctcccgccgacattgatccaaatttgaaaaaactgagtcgtaaaaatactcggcagcgcctcgcccgcttggaaggcaagacggttggcatccatcgcgccgtaccaaatcggcgacatgattccgccaatgatggaagccccgtgaatcccgcacgaccaaagcagcatctgtacaaattcagcaatcaggcttccgccgagactgccgccaaggatggaaagcggtgtgccaagcaggtctcctacgacattgtgcagactctgaaaaggtgtcatttcaatcagaaggcgcgccagccacacgagaaacacaatgataaagccgggaatcagcgcgacaaacgatttgcttaccgcaggcggcacaccgtctggcattttgaagacgatatttttttgaataatgtaccgatagatttcggttgaaaacaaggcgatcagcatggcgacaaataagcccttgctgccgagcagcgtgatcgggattccgccccctaccatgatggactccgttgagccatgcggtgtaaacggcacctcaaacggcgttgccagcagaaatgcggcaattgaaatcgctccggcagaaagggcatcgacaccatagctttctgccagccgataggcgatcccaaaagcggcaatcatcgccataatatcaaacgaagcattgacgggatatccgagcttatcagcccactctttcccaaacacactcgccatgaaatcagcataccccggaatcggcaggctcgttaaaatcaagaagacagacccgataataatcagcggcatggtcaggataattccgtcacgcaaagcgctgagatgccgctgcccggcaattttcccggcgacaggcattattttttcctccatcacccgagtgaatgtgctcatcttaaaagcccccttttctcattgctttgtgaacaacctccgcaatgttttctttatcttattttgaaaacgcttacaaattcatttggaaaatttcctcttcctgcggaaaaaatctgcattttgccaaacaatcctgtctatgaaaaattttttccttctaactattaatctctcttttttctccgatatatatatcaaacatcatagaaaaaggagatgaatcatgaaaaacatgtcttgcaaacttgttgtatcagtcactctgtttttcagttttctcgccataggccctctcgctcatgcgcaaaacagcagcgagaaagaggttattgtggtttataaaaacaaggccggaaaggaaactatcctggatagtgatgctgatgttgaacagcagtataagcatcttcccgcggtagcggtcacagcagaccaggagacagtaaaagaattaaagcaggatcctgatattttgtatgtagaaaacaacgtatcatttaccgcagcagacagcacggatttcaaagtgctgtcagacggcactgacacctctgacaactttgagcaatggaaccttgagcccattcaggtgaaacaggcttggaaggcaggactgacaggaaaaaatatcaaaattgccgtcattgacagcgggatctcccccacgatgacctgtcgattgccggcgggtattcagctgtcagttatacctcttcttacaaagatgataacggccacggaacacatgtcgcagggattatcggagccaagcataacggctacggaattgacggcatcgcaccggaagcacaaatatacgcggttaaagcgcttgatcagaacggctcgggggatcttcaaagccttctccaaggaattgactggtcgatcgcaaacgggatggacatcgtcaatatgagccttggcacgacgtcagacagcaaaatccttcatgacgccgtgaacaaagcatatgaacaaggcgttctgcttgttgccgcaagcggtaacgacggaaacggcaagccagtgaattatccggcggcatacagcagtgtcgttgcggtttcagcaacaaacgaaaagaatcagcttgcctccttttcaacaactggagatgaagttgaattttcagcaccgggggcaaacatcacaagcacttacttaaaccagtattatgcaacgggaagcggaacatcccaagcgacaccgcacgcagctgccatgtttgctttgttaaaacagcgtgatcctgccgagacaaacgtccagcttcgcgaggaaatgcggaaaaacatcgttgatcttggtaccgcaggccgcgatcagcaatttggctacggcttaatccagtataaagcacaggcaacaaattcagcgtacgcggcagcagagcaagcggtgaaaaaagcggaacaaacaaaagcacaaaccgatatcaacaaagcgcgagaactcgtcagccagctgccgggctccgacgccaaaactgccctgcaaaaaagactggataaagtacagtcatacagaaatgtaaaagatgcgaaagacaaagtcgcaaatgcagaaaaatacaaaacacagcaaaccgttgatacagcacaaactgccatcaacaagctgccaaacggaacagacaaaaagaaccttcaaaaacgcttagaccaagtaaaacgctacatcgcgtcaaagcaagcgaaagacaaagttgcgaaagcggaaaaaagcaaaaagaaaacagatgtggacagcgcacaatcagcaattggcaagctgcctgcaagttcagaaaaaacgtccctgcaaaaacgccttaacaaagtgaagagcaccaatttgaagacggcacagcaatccgtatctgcggctgaaaagaaatcaactgatgcaaatgcggcaaaagcacaatcagccgtcaatcagcttcaagcaggcaaggacaaaacggcattgcaaaaacggttagacaaggtgaagaaaaaggtggcggcggctgaagcaaaaaaagtggaaactgccaaggcaaaagtgaagaaagcggaaaaagacaaaacaaagaaatcaaagacatccgctcagtctgcagtgaatcaattaaaagcatcccatgaaaaaacaaagctgcaaaaacggctgaacgccgtcaaaccgaaaaagtaaccaaaaacctttaagacttgcattccaggtcttaaaggttttttacattctaagaacatcacacacaacctttttcccatccattgtacaggcttttcatactattgctatacagccatgaacagcataaaatgaacgttattacagttatcaccacatatggcgggattgtgactgggcaggcaggcaagacccaatgatgcaaagggagtattaatgcctaaaaagcagggcattttaactcttcttttcgtgttgggctcataacggcgccttggacaaccccctattctcatgctccgtcgtcgacgcgggcatttttgtcattttcagccggtatttctcacttttttcattttgattgtcaacttttcatttgatacgatgaacaagccgacttttcttcagcaaaggaggttttgattgtttgcataaagagattgcaaaagaattactgctgctcgcaggaggaaaaaacaatattatcagcatcagccattgtacgacccgtcttcgttttgatgtaaaagacgagacgaaaattgatatacatgccattgagaacctgcaaggtgtgcagggcacctttttccgctatgggcttttccagattatcttcggagcaggcgtcgtcaacaaaatttataaagaagtcgttcatgtatgggagaccgcgccttctgaagagcctgtccaccagaaaaaagccagccggaagctgaaccctgccgcagcttttgcgaaaacactgtccgatatttttgtgccgattattccggcaataacagcaagcggcctgctcatggggctgatcggcatgattaaggtgtttcattggttcgctgccggcagcccatggattaaaatgctcgacctcgtgtccagcacagcctttattttactgccgattttagtcggcttcagtgctgcacggcaatttggcagcaacccatacctaggggcagtgattgcagggcttttgacgcatcctgatctgctggacccgtctatgctcggcagcaaaaccccgtcttctttagacatatgggggcttcatatcccaatgatgggctatcagggttccatgataccgattcttctttccgtttttgtcatgagcaaaattgagaagctattaaaatcgattgtgccgaagtcgcttgatgtcgtgatcattccctttattacggtcatggtgacaggatgccttgcgctgattgtgatgaatcccgccgcgtccatcatcggccagatcatgacacaatcgatcgtctatatttatgatcacgccggcattgccgccggagctcttttcggcggcatctactccaccatcgtcctatctggattgcatcatagcttttatgcaattgaggcaacgctgcttgctaatccgcatgtcggtgtcaactttttagtgccgatatggtcgatggcgaatgtggcccaaggcggagcggggcttgcggtattcctcaaaacgaaacaatcaagcctgaagaaaattgcgctccccgcttctctgaccgcgtttttaggcattgttgagccgattgtattcggggtaaatctcaaattgatccgtccctttatcggagcagccatcggcggtgctattggcggagcatacgtggttgcggtacaagttgtggcaaattcctacggactgacaggcattccgatgatttcaatcgtgctgccgtttggcgccgctaattttgttcattatatgatcggtttcttgatcgcagccgtctctgcttttatagctacattgtttctcgggtttaaagaagagacagaataactggatttattcgttttcattcataaaacgggggatgaaaggacaaaaaagctatgaaaattaaaagaatcttaaatcataatgctatcgtcgtaaaggatcaaaatgaagagaagattctcttaggtgcaggaattgcgtttaacaaaaagaagaatgatattgtcgatccgtcaaaaatagaaaaaacctttatcagaaaagatacacctgactataagcagttcgaagagattttagaaacattgcctgaagaccacattcagatttctgagcaaattatctctcatgccgaaaaagagctgaatatcaaaatcaacgagcgcattcatgtcgctttttcagaccatctttcttttgcgattgaacgcctgagcaatgggatggttatcaaaaatccgctgctgaatgaaatcaaagtcctttatccaaaggagttccagatcggcttatgggccagaacactgattaaagataaactggggattcacattcctgatgatgaaatcggcaatatcgccatgcatatccacacagcaagaaacaatgccggcgatatgacacaaacgcttgatattacaacaatgatccgtgatattatcgagattatcgaaattcaattgtctattaatatcgttgaagataccatctcttatgaacggcttgtgacccatctccgctttgccattcagcatatcaaagcaggcgaatccatttacgagctggacgcagaaatgatcgacatcattaaagagaagtttaaggatgccttcctgtgtgccctaagcatcggcacctttgtgaagaaggagtacggctttgagtttcctgaaaaagaattatgctacatcgccatgcatattcagcggttctaccaacggtcagtcgcacgctgagacaaaaaaacgcttttgatcatctcaaaagcgtttttttatctaatttattggttgatcgccggattcccaatcgtattccacttcgtataggacatgtaatggaaatactcatcgcgatacggatgttttgtattggagttccaaggcttttctccgccgcagaagtgcacgattgccgggttttctctcgtttcattatattgcttccgccctaacagagtcgatggggttttcagctttaacatgatataggtttgagcgttccagcgcggatgaagttcataccactgatcatacaagatcgcattcagtgcatcttggtcatgcagcacaagaaagtcttcgtctgggtgttcattgataaagttgatgactttctctgtgatgttttgctttctccaagactcaaaatcaataatcatgatacctgagttaaaatacttccctgtatcagtgacgttcatttctttcagtcgttcatgttgccccgcatcctcaacagcggctacggtgtatggcgcaatgtctaagtcccatagcttagaaatatcctctaggacaagcgcatcacaatcgatgtaaatcattcgtttgatgctttcatccttaattaagtcgggaatcgaaatgcggtaatacgcggcttttgtaatatggctgctctctaccgcatgttcatacatgttggtatccacttctaaaaactcaatcggcactccgaatttcaaagtggtttcttccagtctttttttgttatcaggcttaattccgccatcaatgacgtataattttacctctctctcctgatccatgttagtcaataaagaaacgaacatcccacctaaatgacgagcataattatcatctgcgcatgatacgatatgcatgatttcatctttcctcaatggtattcatctccctttttgttgtacaagttacataccctttttcaaaaaaataaacacgttctccgacatttttttaaacagaatgtgtgatacaacaaaaaaggtgtcattttttgaagatgcgataaagcaaataaagaatgaaaaagctggcgatcgtgatggcttcagccgagacgatataccaaggccatggcccgagaacatctaagagagaggaaccgcccggttttttcgtcaaatacatataattcgcgccaagccagcgatcaatcagaaaaatacagacgccgtacacattaacaagcaggactgtcacccataacgagcgctggcccattctgtaggtgccaatcacagccatcagcagacaggataaaaacacagacccgtgagaaataaaaaagaggatatatcggatatgcggaaatgaaaacattccgaggtcaggagtggcaagagcctgaatcgaactgccgatgccgacaaaaaacaaaaacacaaacagctttctgctttttgtcactaacataatagctgacaaatacaccgacaggtcactaagctggagaggcaatgaagtgcgcaccgaccacctgcccgtggcgatcatccatatttgatagccgatttgcgaaccaagcaaaagaaacacaaacagagaacgtaaaaaccggctggccctcggctgcttgaccccctcttggaacaaaaacaacagaatggccaaaagggcgataatcgctaacgtcactacatgctctgtcgaaaacagatgaaacggatcatgcttatagacggattgaacatatttttgcaaaactgcacccccgtttgcgggttttgtttattttggcgttgtttgggctttttttattcaccgatatatgggcttgaagttcacatcagagtctgttacaattcgtttcatagctaatgattctgataatttaaggcaggcctaaaaaatggaacgttcacatcaacatcagcagcttcggaaggaagaacacgatacactttctaagctcaaacaaatgcccgtcgagtcactcaacctagaagccatttcgatcgctacgaatctgtatcggtctgcacaaaggctccgtgtcaaaatggagactgaggttctttcttcctataacctttcttggaccgctttctccattctttatgatctatgggtatggggagcgctcgaaacgagaaaaatcgctgagctgtcagggatatctacagctacagcaagcaacgtgatcaaaacgctcgaaaaaaagagtttttgcagtaaaagcatcgacacaagagatcggcgactcgtgtttgtctcaatcaccgattccggcaaacaagcgatcgaagaactctacccggagtttcacaaaggggaaacagagctcattgcgggaatgacgaaggacgaacagaaaatattgacagggctgcttagaaaggtagctgacaatcttcatacaacataagctttgacgggaatccagtagcggtttgtctacctgtttcagagagccggcggaaggtgcgagccggcacacagcaaacgtgaattacctccccgagctttctttgtgaaccttaaaagtagcaaagaacgggaaaccgttattcgaatgagcggaagacaatgtcttcaaccagggtggtaccgcgtgcattgagccacgtcccttattgggatgggctcttttttgtgtttgtaaaaaaggaggaaaaatgatgagaacatttgagcagctcacagcgtcacagcaaaaagaggtagaaagacagcttcagctatacatgacaggcgcccacgaagtcataccgccggaggaattaaaggcaaagctcgtgaaatcaatttccacgggcacgccgcttaaaattaagctcggattagatccgtctgcaccggatgtacatttgggccatacggttgtgttaaataagcttcgccaatttcaagaaaacggccacattgtccagctgttaattggggatttcacaggaaaaattggtgatccgaccggaaaatcggcagcccgaaagcaactgactgatgaagaagttcagcacaatgccaaaacctactttgagcaattcggaaaagtgcttgatccagaaaaagtcgagcttcactataactcaaaatggctgaaaacattgaatctggaagatgtcattgaattagcagggaaaataacggtagcccgcctgatggagcgcgacgactttgaagaacgcatcgccatgcaaaaaccaatctcactgcatgaattcttttacccattgatgcagggatatgattctgtcgttctcgaaagtgatattgaattaggcggaacggatcagcatttcaatgtcctcatgggacggcatttccaagaacgatacaacaaagaaaaacaagtcgtcatccttatgccgctcttggaaggcttggatggcgtcgagaaaatgtcgaagtcgaaacacaactacatcggcattaacgaacatccaaacgacatgtacggaaaaacgatgtcactgcccgacagcctgatgaaaaaatacatccacttggcgacagacttagagcttgaagagaaaaaacagctcgtaaaagacttagaaaccggcgccgttcatccgcgtgatgccaaaatgcttttagccaaaacaatcgtccgaatgtatcacggagagaaagcagcagaagctgccgaacactcgtttaaaacagtctttcaggaaaacagcctgccggaagatataccgaccgtaaactggaaaggcgaaaaaacgatagcgatgattgatctgctcgtcaagctaaagctcctctcttcgaagagcgaggcgcgccgcatgattcaaaacggcggtgtacgcatcgacggagagaaaataacagatgttcacaccaaagcagagataagagagaatatgatcatccaagtcggcaaacgcaagtttttaaagctccaatagtctgatattccgaaacgcttatgacccttcattcataagcgtttttttgcaggtataaagcactgtcttttcaaaaacgctctccatcttgcaggaaactcctttagcatcccgaaatattccccaaccatacatttaggggaggtttatttttgatgaaaaagcttttgactgtcatgacgatggctgttttaactgccggcacactgctcttgccggcacagagtgtcacccctgccgcgcacgctttacaaatatcaaatagcgagcgcgagcttccattcaaagcaaagcatgcgtactctaccatttctcagctaagtgaagcaatcggccccagaatagccggaactgcagctgaaaaaaagagtgccctattgatcgcctcatccttgagaaaattaaagcttgatgtgaaggttcaacgattcaacattcctgaccggcttgagggtacactgtcttcagcaggacgcgatattcttctccaagcggcgtcgggctcagctccgactgaggaacaagggctgacggccccgctttacaatgcgggattgggctatcaaaaggactttaccgctgacgccaagggcaaaatcgccttaatttccagaggagacctgacttattacgagaaagccaaaaatgccgaagccgccggagcgaaagctgtcatcatttataacaacaaagaaagcctcgtgcctatgacgccaaacctgtcgggaaataaagtcggcattccggtcgtcggcattaagaaagaagacggcgaagcacttacccagcaaaaagaagccaccttaaaactaaaagcattcacaaaccaaacctcccagaatatcatcggaatcaaaaaaccaaagaacatcaaacatccagacattgtgtacgtgacggcccattacgacagtgttcctttttcacccggagcaaatgacaacggctcaggaacctctgttatgctggagatggcgcgtgtcttaaaaagcgttccatctgataaagaaatccgctttatcgctttcggcgccgaagagctcggcctgctcggctcctctcactatgtagatcatctatcagaaaaagagctgaaacgaagcgaagtgaacttcaacttagatatggtaggcacaagctgggaaaaagcgtctgagctgtatgtcaacacattggacggccaatctaactatgtttgggaatccagccatacggctgctgaaaaaattgggtttgacagcctgtctctgacacagggaggatcatctgatcatgtgccattccacgaagccggcattgattccgccaactttatttggggagacccggaaacagaagaagttgagccgtggtatcatacccctgaagactcgatcgaacatatcagcaaagaacgcctccagcaagcaggcgatcttgtgacagccgctgtctatgaggctgtgaaaaaagagaagaaaccgaaaaccattaagaaacaaatgaaggccaaagcaactgacatttttgaagatatcaaataaaaaaagacggcacttgggtgccgtcttttttttataatgatcagctgtttagccgtctataagtaaagctttcagtttatcaactgtattttctttttctaacggccgataaatggtcagtttcaaatcaggagagtcatatatttgtaatgtcatatgctccatcaccattgttccggctgccgggtgatgaagtactttttctcctgcgtgtgtgcctaatacttcgtggtggttccaccattttttaaattcggggcttctttcagttaactcatcgatcagctcttttatccatgcttccccaagaaaccggctggctgtcgatcgaaactgtgcgataagttttttggcgtggctttcccagtcgtcaagcagattccgatactccttcgaggtgaaacatcgccatatggcgttcctttccttactgcccatttggccaaaattgccgaacacagcacaagctgctgtgttccaagcaataacgtcccacttttcgtcagtcacataaacagggcaattggttaaatgatcaataaagtgccgcacagccagaggaaggctcttattatcttcatcctgatcatctaaaggaacatgatggccagccaacagaaagacatgacgcttttcctcataattcaatttgagcactctcgatatgctttccagtacctgtgttgatacccgaatatcccttccctgctccagccatgtgtaccatgtgacacctataccggacagctgggccaattcctctcttctcaagcctgttgttttccttctggtgcccataggcaatccaaattcttgcggagaaagctgtgcccttttcagttttaaaaactcccctagctctttccgtttttctgcgatactgtccacatacacactctccttctgcatagaatttcctattagtattctacataaaaaggagaaggtttttatattatttgtttcgttctgcaaatacttccgcggccacaggaagaatggtattcagtgcattcgggaaacctgagtaaataatcatctgcatcatgacttctatgagttcttcttgtgtccatccgacattcagggctccgttaatatagaattttagctgctgggtattgcccaatgcagtcaatccagcaacggttgctaataatctggatttcagatcaagacctggtcttgaaaaaatctgaccgtagttaaactccacggcaagcacaccaaggtctggagcgatggaatgtttaaaattgtccacgatcgcttcatagttcttctcatcaatttgtttcagaatatctaacccttttttataacgttcacttgttcgcaccagcttctatctcccttccaatatcgtttttttagtagtacgatttatggtaatccttgaactgaaggcaataccgaccatgatcatccccagaatacaaacaccgttccaatgaaacagcatccagactgcacctcctgcatacgatcccaaggcgccgcctaaaaacgtgctgaccataaagaggccattcaatctgcttctcatttcagccgacaattggaaaatctccgcctgacacgccacctgattcgcctgaatgcccatggtgatgaataaagcgcccaatacaatcacaatcaatgaagtctggcctgccattaataaaacaaatgacaataaggtaaaagacatacaaagcttgttggaaaaagcagctcctttttgatcaataatccggccgatcagcggagttgcaaaagccccgccaattcccaccaaaccgattgttccggcagtctggctgccaaacgagaatggaggttcactcaccataaacactaacgtcgtccaaaataaactgaaggcgccgaacatgaagccttggtttacacatgcttttcttaacactttctccttgatcaaaagcggaaataatgaagaaatgagttttccgtaatgaaatgcatgtgtccctttgcttttcggaaagcagaagtgaataatcaacataatgatgacggctgctgcacaggcaatccaatacatcacgcgccagccataatgggcatctatcgccccgctgaccactctcgcccctaaaattccgcaaaccaagccgatggctacgtttccgagtacttttcctctgttcctgtcatttgctaaacctgccgcaaacggcacaaggatttgaggaataatcgtgaagaatcccaataataaatttgtgatgactagccatagaaagcttacagctaacgctgaagcggccgaacaaacccccactaagaatagcaggctcacaattaagcggcggcgttcaaaaagatctcccaatggaacaagcagaaggttccccgccgcatagccaatctgcgccaatgtagcaatcattccagcttgtgccggcgtcatatgaaacgtgcctgccatgctgacaagcaatgtttgattgatatagacattggctaccgtaaacccgctagtcaccgcgataagaaaaatcaaacctctcgataatgaaatggaatggttcatgtttacctcctttcttcatgcatgataaagcaggttcaatcatggaaacagaagtgagtttatactggtataaaaagtactagcaagcaaagcaaaaaagcgaaaccctgtcaggcttcgcttttgttatcaatccacttctttcttaatccccagcattttctcatctaggtaatgggcaatctccgcggcttctttcagctcatctgttaattgcttaggaacgtcattgttcaatttataataaattttatgttcaaggctcgcccagaaatccatcgcgattgtccggatttgaatttctgctttgacgtattccacacggttcgttaaattcacaggcatctcaatgattaaatgcaggcttcgatagccattcggtttgggtgtctggatataatcctttacctttacgattctcaaatcttcatgctgcttcaacacattcacgacattataaatgtcagaaataaaggaacagatgatgcgcacgccggcaatgtcgtgaatatgttccttcatttccttcgtcgtaatctcacagccctttctcattaacttattcacgatgctttcaaagctttttacacgggattttgtatgttcaatcgggttgtgtccgtgaatgaggttatattcctggctgataattgagaactttgtatcgagcgcatctagcgcaaatttataaactaataactcatttttccaatcttccattactgtttttaaatcgtccatatgtgttacagataaatccatgttcgtcatctcctttaacggaactttatccgctgtccatgtactagacgtccctgtctgctgcaaggttctatgaatttttttacaaaatgcggtcgattgtaacaaaaaaagaccgcatgaaacgagcggtcttttttattatcggaaatagctgatcaataatccgatcgagagcaggaatccgaaaaatgtatttgtttgggctgttgatttcattgcgacaatcatattcatcggcatttcgttctggacgaagcccttcactgcctgaaccggcttaggcacgctcaaaaagacgacaaacagccatgggcttgcggcaccggtaataaccaagccgacaacccagatataagcgacggcaaacgacgcagctaacagagtaacagctcccttatgccccatcaaaatcgccaatgttttgcgtccgccttttttgtcctcttcaatatcacgaatgttgttcgacaggttaatcgcgccgacaagaatcgcaatcgggatggaaatcaaaatgctttgcgtgttgatcatatctgtctgaatgaaaaacgaaatcagcacaaacaccgaacccatgcaaatgcctgagaataattcaccgaacggcgtgtacgcaatcgggagcggcccgcctgtatacaggtagccgatcgccatgccgacaaggccgatcagcgcaagccaccagctgctgctcgcacaaatatagacaccgagcaaaatggcaatcccgtatgaggccagagctaattgcaaaatcgttttaggcttcattccgtggcgtacaattgcccctccgattccgactgattctgctgtatctaatccgcgtttaaaatcataatattcattaaataagttcgtcgcgatctggatccataggcaagaaaacagcatagccaaaaacagcagcagatcaaccttcacataaaacatcgccaaaacggttccgagcagcacaggcacaaacgatgcggttaacgtatgaggacgggttaactgccaaaggatctgccccatgctttctttttgcggcgctgtctgaccctcacccttatttgtttggttcatcttcctcttcctttctattaaaaggcttactttttttcagccggcagcttaataaaaaactccttttgcttccttatctatcataatgacttctcccttatttcacaagataccgcaagaaggcgttttctttcttattatacgcttctcgccctgatttcattaggtttctgctttcacttgaacgaacaggtacagaaaaatttttttaagtacattacactttttaaaagttaaaaagatcttttgactccagctatcttttcctttattatgaatcagctcgaaacattccattcttgcccttgcaggtataaagattcattttcaaaaacatacgccgatatattaatttgagggagattagggaaaaaatgaaactttttgagcatctgatcgtcaaataatcatgtgattgtcgaaaaaacgggaagggaatttttgatatgctgcaattaatgaaacagctgtatgaaaaacccgctgtcaagtggacatgtcatacaggcttttatttgatgatactgcttgttttgttttttatgtatggttttcacaccgcgaataccggttcatatatttataacgatttctaattggagagagaataactatgaaacttttacatgctattcaaacacatgcggaaacttatccgcaaaccgatgccttccgctctcaaggccagtcgctcacgtatcaggaattatgggagcagtctgaccgcgcggctgccgcgatccaaaaacgcatttctggggaaaagaaatctcctatccttgtgtacggccacatggagccgcacatgatcgtttccttcttgggaagtgtcaaagcgggacatccttatattccggttgacctttctattccgtccgaacggattgcgaaaattatcgaaagctctggagcagaattgctgatccatgcagcaggactctcaattgatgcagtcggccagcagattcagacagtttctgcggaagaactgctggaaaacgaaggcggctctgtcagccaagatcaatgggtcaaagaacacgaaacgttttatatcatttacacttccggaagcacaggaaatccgaaaggcgtgcagatttccgctgcgaatcttcaaagcttcacagactggatttgtgcagactttccagtcagcggaggaaaaatatttttaaaccaagcgccgttctcatttgatttgtctgtcatggacctatatccgtgccttcaatcaggcgggactttacattgcgtgacaaaggatgctgtgaacaagccgaaagtcttatttgaagagctgaagaagtccggactgaatgtgtggacatcaacaccttcctttgtgcaaatgtgcctgatggatccgggtttttcacaggatctgctgcctcatgcggacacatttatgttttgcggagaggttcttccggtttctgtggcaaaagcgctgcttgagcgttttccgaaagcgaagatttttaatacgtacggcccgactgaagcgacagtggctgtcacatcggttgaaattacggctgacgtcatcagccgcagcgaatcgcttccagtgggcttcgccaaaccagatatgaacattttcattatggatgaacagggacagccgcttcctgatggagaaaaaggagaaatcgtcattgcagggccgagtgtaagccgaggctaccttggtgagccagagctgacggaaaaagcgtttttctctcatgaaggccagtgggcataccaaactggcgatgccggctttattcaagacggtcagattttctgccaaggacgtttggattttcagattaaacttcacggctatcgaatggagctggaggaaatcgagttccatgtcagacagtcacagtacgttcgctctgctgtcgtgattccttatcagccaaacggaacagttgagtacctgatcgctgctattgtgcctgaggagcatgagttcgagaaggaattccagctgacaagcgctattaaaaaagagcttgccgcttctcttccggcatatatgatcccgagaaaatttatctatcaggatcacattcaaatgacggctaacggcaaaattgaccgaaaacgcattggcgaagaggttcttgtatgacgccttacagctcgtttttattctttatactgctcggcattcttcttctgccgacgatcattctcggcttaaacggaaaaagatttcaagcatacaacatgttcatatctatcattatattggctttaattttttcgcacgacttacacggggtcatcgcgctgtgcctgtttacaatatggcaggtgctcctgatcagcggctatctggcataccggcagaaagcgaacagcggctttgtcttttgcggagctgttatcgcgtcgattctgcctttatttctgtcaaaaatatggccgtttctgtcacacccgcagccgcatcatccgccgcataacctgatcagctttttagggatttcatatttaacctttaaaggcgttcagctgattatggaagcaagagacggactgctgaaagaacagctgccattgcaccgcctgctgtatttcatcctgtttttcccgacgatttcctccggcccgatcgacagataccgccggttcgtcaaggatgaacagaaggcctggacgaaagaagaatacgccgacctgttgtatacgggaatccataaaatcttcatcggttttctgtataaatttattatcggctacgcgatcaatacgtacttcatcatgaatcttcccgcaatcacgcacaataagattcttgggaacctgctgtacatgtacggctacagcatgtatttattctttgatttcgccggctacacgatgtttgccgtcgggtcagctacattatgggcattaaatcaccggaaaactttaataaaccgtttatcagtaaaaatattaaagatttctggaatcgctggcatatgtctctgtcattttggttcagagattatgtgtttatgagattcgtattttggatgactaagaaaaagtggatcaaaaaccgtatggccgtctcaaacatcggatatttcctgctgtttatgctgatgggggtttggcacgggctcgcgccgcaatatatcatttacggcctctatcacgccgttctgatgacgtgttacaactttttcgagaagtggaataagaaatataaatggctgccgtccaaccgctggacaaccattctcgcgattgtgatcacattccatttcgtttgcttcgggttttatattttctcaggaaaaccatttcatcaccaccattaaaggagattagaaagctatggattttaaacaagaggtattagacgttttagcagaggtttgccaggatgacatcgtaaaggaaaatcctgatattgaaatttttgaagaaggtttgcttgattcttttggaacagtagaattgctgcttgcgattgaaaaccgttttgatattttagtgccgatcactgaatttgaccgggacgtttggaatacacctaacaacattgtaaatcagctgtctgagttgaaataatgaaaaagcgttttttcggtccaattattttggcgtttattctattcgcaggcgccatcgcaattccatcttcatggctgacaggcttcatcaccgataagcgtgtgaaagagtcagcaacagccttgaatccgagtatgtttcaagggctatatttacaagatcagatgctcaaagatccgacatatcttccgatttacgggtcttctgagctttctcggctggacgagttccacccatctaattattttcaggtaaacaatgagggattcacgccataccttgtcggcaaaggcggatcccagtcattgattcattctttaaacttcgctgcccatatggatcagctgaagggcaaaaaaatcgtattcatcgtgtctccgcaatggtttattaagcgcgggtctgatgaacagcatttcgcgccgaactattctgcgctgcaagggcttgatttggcatttaacgatcagatcgatcctgaaattaaaaagaaaatgatgaaacgcatgctgcgctttaaggctgtgcaaaacgatgccattctttctgagctgtacaaagcaatggtaaacggccagacgtggaaagtgaacgcgctgaagccggcggccaaagtgtattacagcatgctggaaaagaaagatctgtattattcaacgacagaatcatccgggccaaagcgctatatctcgcagtcagtaaaggataagtcatggtctgaattgaataaactagcggatcaatcaggcaaacgccactccggttctaacgattttcacatcgacaaccctgtctataaaaagctgaagccgaaagtgcctaagctgaaagggaaaaacaaaggaagatcgtatgcggtgtcaccggaatatggcgactttgaaatgatgctcgatatcctgaaggatgcgggcgcagagcctatgtttgtcaccattcctgttaacgggaaatggtatgattacacgggcttcccgaaaaaaggacgcactgactattacaaaaaggtaaataaacaaatcagagcgaagggcttccaggttgctgatttctcagggcatgaatatgacccgtatttcatgaaagacaccattcacatcggctggaaaggctgggtgtatgtcgataaagcaattgacgaattttataaaaccggaaaagtcacttcatcctgagcatctcataggacgcggctgcatatttcctgctaagatttgaaatagtaaagaaatcacagccaacttaattaagaggtgttacatccaatgaagatgacaaataatacggttttaatcacagggggttctgctggcatcgggcttgaactggccaagcgcctgctggagctcggcaatgaagttatcatttgcggacgcagcgaagcacgtcttgcagaagcgaagcagcagctcccaaacatccatacaaagcaatgtgatgttgcagaccgttcgcagcgggaagcattgtatgaatgggctttaaaggaatatccgaacttgaatgttctcgtcaacaacgccggcattcaaaaggaaattgactttaaaaaagggacagaggagctttttgtggacggtgatgaaattgaacttaatttccaagcgcctgtccatttatccgcccttttcacacctcatttgatgaagcagcccgaggcggcaatcgttcaggtcacatccgggcttgcgtttaacccgttagctgtttatccggtgtactgcgcaacaaaagcggcacttcactcgttctcgcttacgctcagacaccagctccgcgacacgagcgtggaagtgattgaaatggcaccgcctatggtggacaccggcttaaaccaaaaatcacgcgataaacaaggcctgacgtaccggggcatttcatctgaagaatatgttcaatatttcttggacggcttgaaggaaggcaaacaggagattacaaatgaacgtgttgaaggtcttcgggatgccactcgcgccgattatgacaggttattcgagcaaatgaacacgcaggagaattaatttctcctgcttttttcatatgaatttcttacaaatttgagcaaacctattgcgattatttgttgaaggtatacaatagaatataaattattttcaaataagtttgataatataaacaatttaacagcagggagattgaccatgactaaacaaacaattcgcgttgaattgacatcaacaaaaaaaccgaaaccagacccaaatcagctttcgttcggaagagtgtttacagaccacatgtttgtaatggactatgccgcagataaaggttggtacgatccaagaatcattccttatcagctcttatcaatggatccggccgcaatggtctatcactacggccaaaccgtatttgaagggttaaaggcttacgtgtcagaggatgaccatgttctgcttttcagaccggaaaaaaatatggaacgcctgaatcaatcaaacgaccgcctctgcatcccgcaaattgatgaagaacaggttcttgaaggcttaaaacagcttgtcgcaattgataaagactggattccgaatgcggagggcacgtccctttatatccgtccgttcatcatcgcaaccgagcctttccttggtgttgcggcatctcatacgtataagctcttgatcattctttctccggtcggctcttattacaaagaaggcattaagccggtcaaaatcgctgttgaaagtgaatttgtccgtgcggtaaaaggcggaacaggaaatgccaaaaccgcaggaaactatgcttcaagcttaaaagcgcagcaggtcgccgaagagaaaggattttcccaagtgctttggctggacggcattgagaagaaatacatcgaagaagtcggaagcatgaacatcttcttcaaaatcaacggtgaaatcgtaacgccgatgctgaacggaagcatcctggaaggcattacgcgcaattcagtcatcgccttgcttaagcattggggctttcaagtttcagaacgaaaaattgcgatcgatgaggtcatccaagcccataaagacggcatcctggaagaagccttcggaactggtacagcagctgttatttccccagtcggcgagctgatctggcaggatgaaacactttcgatcaacaacggtgaaacaggggaaatcgcaaaaaaactatatgacacgattacaggcattcaaaaaggcgctgtcgcagacgaattcggatggacgaccgaagtcgcagcgctgactgaaagcaaataagaaaaaagccggcccattacaggccggctttttttacgcttcaattttgttgaaaaactgcggcagataccctttgtgcgcctccagcatttcgtctaaaatctgtttggccacagtatcggacgggacaagcgggttaatcgtcatggcaaggagtgcggtttgatagtcacctgtaactgccgcttctgccgcgacacgttcaaaggatttgatttgctggacgaggccgcggacagacaccggcaagtcaccgacagcaattggcttagggccggttttcgtcatcacacagttcacttcaactgcggaatcgtctggaatgctcgctatcgcaccattattgatcgtgtttaccggctgaatgtcatgtttatcattataaatggagctgattaagttacatgctgcatcactgtagtaagccccgccccgtttttccagctgcggcggtttgatcgcaaggttcggatctttataaagctcgaacagctctttttcgaccttctgtacgacttcagcgcgggtgccctccgtttgtgatgcttccagttcgtgctccagcatctcttttgttttgaaatagtaacggtgatagccgcaagggatcacattgagcgcttttaagaaatctggttcccattcggcgcctgagatatttttcatcgtcatcgcgtttttcgggtcacccatcgcctcgatgacttgctctttcacacttatgccgtccaagaaaacatccagcccgaataccatatggttcagtccggcaaattggacttctacgcggtccacatctacatcaagcgctttggctacgcccattttgatgccgattggaacattgcaaagaccgacgactttcttcaggttggagtagcgaagcaaggcttctgttaccatgccggcagggtttgtgaagttaacaagccaagcgttcgggcaaagctcttctatgtcctttgcgatctcaaggatgaccggaattgtgcgcaatcctttaaacaggcctcccgggccgtttgtttcctggcctattacaccgtattttagcggaatgcgctcatcctttgctcttgcctgcaaaagtccgacacggaattgggtcgtaacaaagtctgcgtctttcagcgcttttctccggtcgagcgtaagatgaatgtcaatcgggacgccagctttttcaaccatccgtttggcgagtgtgccgacaatattcagcttttcttcgccctcagggatatcgacgagccataattcgcgcacaggcagctcatcataccgtttaatgaacccctccactagctcgggcgtatagcttgaacctccgccaatcgttacaatcttcaatccttttgtcatatgcttgctcccctttgctcggtgattttttcatataactcaatgatctctgcagccatatccttcactgtcattgcattcattaaatgatcctgtgcatgaaccatcagaagcgtcatttccgtcttttctccgcccgcttcattttggatcagctctgtctgataatgatgggcttttgacaattcttcagcagcgtcttgaagctttttccgcgcttcttctgcgtcaccgcttttcgcagcggcaatggcctccattgcggagctcctaccgtttcctccgtgaaggatgatttgaaaaatgatttgttccatttcctcattcacgcgattcacttcctttctctacagagccgcttctttgtcatctgatgttgcaggcgtttgaaccagctccagatcgttttcttctttcagcttctgcttatcccacattctgaagaacgggtagtagacaacaaaggatacgacaatattaatggcttgcatgaccgcgcctgagacttttcctcctgtcgccaagtagcctgaaaagatcggcggcatggtccacggcactgcgatacccgccggttttgcgacaaggccggtgctcattccgatgtacgtaagtgtcactgtgacaagcggtgtgatgataaacggaagtaagagcattgggttcatgacgatcggcattccgaatataatcggttcgttaatattgaagatggccgggccgaccgcaagcttcccgagctgcttcatttgtttgcttcgggcgcgcaggaacatcgtgacaaccagtgccaatgtggcgccgcttccgccgatattgacccagatatcgaaaaattgctgggtgaaaatcttaggaagctcctcaccggcttggaatgcgatccggttggcatccattgcgccgtaccaaattggtgccatgacgcctccgacaatgtttgcaccgtgaaggccgcaggcccataaaagcattttgacggcttcggcgacaaggcttcctccaaggcttcctcccagaatggaaagcggagtccccaataaaacgcttacaatgttatgaaggctttcaaacggtgtcgcttcaacaatcagccgggctgcccaaattaggaagatgacggcaaagccggggattaacgcgacaaatgacttgcttaccgccggcgggacaccgtccggcattttgaagactaaattgcgctggataataaggcggtaaatctctgtggacaccattgcgataatcatggcgacaaacaggcctttgcttcccatgagcgaaagcggaatcccgccgccaaccatgatttctttcgtcgcgccatccggcataaacggcacttgataaggtgttgctaataaaaatgccgcaagggaaatggctccggccgacaaggcatcaacgccgtatttctcggcgagccggtaggcgatgccgaacgcggcgacaagacccataatttcaaaggtcgcgtcgactgggtaggccagtttttcagaccaggagctgccaaacgtttttgccataaactcagcgtatcccgggatcgggaggttgccaatgatgaggaaaaaggaaccgatgataatcaggggcatcgtgaggatgataccatcacgcagcgcctgcaaatgacgctgtcccgcaattcttcccgctataggcatgaccttttcttctaagatctgattgactttattcacatagcccgcccctctctatgacacatgtccaagctgttcagctgatttcagcacttccgccccgttgcacgtgccataatggacggtattaatgacgtctacaggaaccccctttgactctcctaattttttgagctgcggaagcatgtaacggacttgcggaccgagaagcaatacatccgctttatcgatatgattttgtacagaatcgcctgaaactgcccaaatggtatagtcttttccctgttcctgcgcacttttttccatcttgctcaccagtaagctagtagacatgcctgctgcacaaacgagtaatatattcatgtaaaagaccccctagagtttgatcaattttgtaatgtcctgctgttgctatcatcatattatgaaatcgctttcataaacactcagggtttttccgcaggcaacggaaaaaaggtatatacaggctgtcagctcagcattttttggtcaaacacatccgaaagctcttgatatgaacgacatttgatcagctggttcaccgccgccgggtcatccaaaatgctgccaagcagtttatacatgctttgcaaatccgctttgttctccttttcgacacaaagcagacagacaaattgaactcgctgactctcccaatcgatcggttttttgagcgtacaaacggcccaaaacgttgttttcgtctgcggaacaagcgggtgcgggatggcaacaagattgccaaaacacgttggcgacatgtcttctctttcaaaaatggaatctatgatttcttcatcggcaaagccgcattcgaccgctttctgccctaaaaattgaatcacttcttcttttgagcgcagatcctcctgaaaaaaaacgagttctttttttaggtagcgattggctttttccttttcatcactcagaatagattctatttttgtaaagtcagttccgcctaagatggtgttaaccttcagtactggtacagggagctcttttttaatcggaatggtgctgatgacaaaatcaattgattcgtaggacatttgatcaagactataatactcagccgttccaagaatatcgagccgcttgccgaaatgggaacggagtttttcgcgcagaagctgggcactcccggcacccgatgcgcatacaatgatacagcgtttcggcgggctttctgttttttttcgttcaatcgcggcgccaaagtggagagccaaatatccaatttcgttttcatgaatctcaatacccgtttgttcctttatcacgattccggcaatgatcccggcttcaaaagcgagtggataatgttccttgatcgctgccagcatcggatttcgaagattcatgccgtatcgattgcggctgatcgccggcttcatatgcagggccaagccgattttcagctctttgtcatgcaggatgccaagcttcagttcacgatcaacagctttgatcatggcaagtgtcagctgatcggtttcctcttctattgaaaatgtgtcctctccgcattgtgattgtgtcattcgttttgtgccaaggagatgcatggtgatgtaggccgtctcgtctttcggaaacgtaacggcaagcgctgattccagctcttttacgatggcttctgcagcctggtactccttttgatgcaggatatgatccatatctttcgggaaaagagatacatagttttccgttctgatccgtttacaggcgatagcgatatggataatgaggttattcagtcccatgttggacagagggatgcggtcgtttttcatttttttcaagatggcggaacggatgatctcaatttcttctttggcaaaatatcagccttttcatttaaaacatctatctccgtttctctttcatcgacaatgtactccgccatgcagtacctcatctgcacctcgtccccgcgcagcttgaagccgtaattcggacgtgtttccatgacgatgcggtaaggcagcagacgtttctttacttcctttaaatccgtttggagtgtagattttgagataaatagttcttcagcaagttcatcgagcttgagataatggtccgccagcagcagacgtttcataagataggccattctctcctccggcaataccggcaggccctttttttgctgaaattcatcttgcagcagtgttctgaatacttgctcgtcatcaatgcggagcttgtagccggagcctcttacagattgtacaaaggcaccgtgaccgcttagcacaccttgaagttcctttatatcattgcggactgtccgcgtcgttacgtttaattgcgcggcaaaaaacgaacttgtcaccggggcttcagccgccatcagcaagcgcagaatatcacgtagtcgcccatgaagcatgagaaaaacctcctaactagtagatgcagggattcagtgaataggcagaaaggatgatgaagggatgcgaaatgtatataaattctataatggagagaatggcaagtcaatgaacatccggaggactagagggaaaactgacctataaaaaacagccgggatcagccggctgttctagatgcggacatattcttttgtttagacgccttgcggtccttcatgatttttcgaacaatcgggtaaatgaccggcgcccatttgataacggttttgatcatctttttcaaagctccgattctcccttctttttctcaaccattcccctgattgcctcttccttaaacatgctaacgcgacacgtacctgtttcccgtcacccagaaacgccatggataatcgcgtgcctccccgctgttgtcaatgccgatgcgcgggccggttgaaattgcttccggtgtgtacccgctttcgatgtaaagcggctgttccgtgatccagcgtccgtagtcattcatcgtgacgccaagcgctttcgtcagctttcctggtccgtttgtccattccctcggactcctgcccggccttctcttctccattaacagctggccttcatgcggctcaatcgccctgattaataccgcttgcgggacatcctcttccgcggcaacgacattcagcaatgtatgggtgtgcatcacgtatgtatatacccgcccagcttctgcaaacatgatctcagtccgcttcgtccggcggttgttaaagctgtgtgccgctctgtctccagcacccatataggcctctgtttccacaatatagcctgacgctgtgccttcgtctgtttcttttacaagaaggcagcccagaagcgatggggcaagctcaagagcggttttttgataaaacgtgatgggcagcggatttttttctctcgtcacgaatcgacctctccttttaccgatttttgtacattgtaccattcccgaagcagatcaaaaaaaacggctgttttaaaatctttccattcagggaatattgttaccgttcaaaaaaggagggccaaccattgaaagatgatcatcaaaacaagcagcaccaatcaaatgcccaagggagcgaggaagcgctttcccataagacatccgggaaaaacgagtcagaggataccttaacgaataggcaggggcatcctgttactgacaaccagaatgtgagaaccgtcgggaatagagggcctacaacacttgagaactatgattttctcgaaaagatcagccacttcgaccgggaacgcatccctgagcgggttgttcatgccaggggagcaggtgcacacgggtattttgaagcgtacggaagcttcggagacgaaccgatttcaaaatacacacgagccaagctctttcaggaaaaaggcaagaaaacaccggcatttgtccgtttttcaactgtgaatcatggaaaacactcgcctgaaacattgagagacccgcgcggttttgctgtaaagctatatacagaagacggaaactgggatttggtcgggaacaacctaaaaatcttttttatccgcgacccgctgaaatttccggatcttgtacatgcatttcagcctgatccagtgaccaacatccaggatggtgaacgtattttcgatttcatttctcaatctcctgaagcgacacacatgatcaccttcttgttttcgccttggggcattccggccaactaccggcaaatgcagggttcaggcgtacatgcctataaatgggtgaatgaggagggcaaggccgttctcgtgaaataccattttgaaccgaagcagggcatccgcaacctgacacagaaggaagcagaagagattcaagggaaaaactttaaccatgccacacaggatttatatgacgcgattgaaaatggcgattatccagagtgggaagtgtatgctcaaatcatgagcgatgatgagcatcctgaactggactttgatcctctcgatccgacaaaactgtggtataaagacgatttcccatggaaaccgatcggcaaattggtgctgaacaaaaatccggaaaactaccatgcggaagtggagcaagcttcatttggaacgggagtgcttgtcgacgggcttgatttttcagacgacaaattgctccaggggcgtacgtttgcctactctgatacgcagcgctaccgtgtaggcgcaaattacctgcagcttccgatcaactcgccgaaaaagcatgtcgccaccaaccaggaaggcgggcaaatgcaatatcgggtcgatagagcagaaggacaaaatccgcacgtcaactacgagccatccattatgggcgggctgaaggaagcgaagcaggacggaaaagaccatacgccgcatatcgaaggtgatgtaaagcgtgaagcgattgacagaacaaacaacttcggacaggctggagaaacgtaccggagatttactgaatttgagcggaacgaattgattacgaatttggtgaatacgctttctacgtgccgaaaagaaattcaggatcaaatgattgagaatttcacaaaagctgatcctgactacggaaaacgcgtagcagaagggctaaaaaggtttccgaaaacaacagcaacgggccgatcggcacaactgaaacggaacaggctgcaaagcaggctgaacaggagagtcatccgtctgatccgtattaaaaacagcaaacagggcttttttagaagccctgtttttttatttttctattgaaacgctttcaataattgtgttgtacttggaaggaaaggggtggagagatacgatggaattacagcaggacttgattcctcagaaaaaaacaatcggcgctttagatcacgccgtttttttatgcatggtattttgtttctggttttcaggctatatttacgttcctgtattcagtctgtatttggaggatctgcacttttcatatggcgcaatcggcatcattctcggcagctacggggtcacgcaaatccttctgcgattcccgctcggccttgtgtcagacatcctgttttccttgcgcaagcaattgttaattgccgggttcggcttttccgtcctcagcagcctgctttttctgatgtttgattctttcttcttcgtgctggccgcccggcttttcgcgggaatcactgcttctatgtgggtgatggcgaccattttatacgcacattatttcaacaatggcaatgcatcaaaagcaatgggcatcatgcagttttttaccgtcatgcctcagtttgccagcattgtgttctgcgggcttgcggcagcccatttaggcaggcaggtcccgttttggatggcgctggcagcctcggtcgcaggtctggtgatctgctgctttattaaggatccgtctgctcctcccgcaaaccgtgacaccattcgtgtcaatcagtacatcaaagatacattgcggctgccaaagctgaagcttttcaccatcctgtctatgacggcccatgccgtattatttatcacagtgtttggttttacgccgctttacatgaatcagctcggaatgggcgacgcggagctgctttgggtgatgagcgcctttttcctcccacacgcagccgccacattaagctttgtgtttctgcgatttacaagccgtatcgcttactccgtgatgctcattagtttcgcagtcaccggggtctgtctgctatacgttccttattcagctgcattgttcacggtttgcatcacacacgcctgtattgggctggcgctcggcttcgtttttcctctgctgctaagccatgtcgtcaaaatcagttctgcccgtttaaaaatgtcagtgatggggttttatcaatcattttatgcgctaggcatcttcctcgggccccttcttgccggaaaaatcgcacagcttatcgggcttgcaggagttttttatggagccgggtctctggcatttgccgccttttttgtgatgctcgcgcaaaaacgtaacatgatcaattaatagctttcataccgccggaagcgccacacagaaaacacggccagaagcatgatgcacagaatggagaaagtgagtgaccatccgaaaaaatctgcctgctctccatgaagaaggatatgctccgcctgcttgcaaatctcagctggaagccacttcgcaccatctggaaatagtgaaacagcaaaggaaacggctgctgtgagcccgatcccgcaagccgcagctgctccgacagaccggaatatcgtacttccggcaaggccggcggtcacaataaatatcacccaaagcgcgtaaaggccaaggcttgcagcaaagcggctgaatgatgcgtcctcaaacagcagccgaacgtaataataagcaagcccgtatccagctgcaaacgacataatgccgatcacgctttggatgagccatttactcacgatataatgggctgccgtcacaggccgcgacataatcagcgctgttaccccttgatttctttcattggctacactgcccatcacgctaaagatgaccagagccatgccaagcgtgttgaattgagaaagcgtgctgaccatcacttcagacccggagggcgtcgtaaaactaattttcatgccgtcaggaagattccctccatgtgcgatgatttccggcatataataaatggtcagcggctgtgtcagcccgacgatcatcatcgcaatcggcagccaaatcagcttgccgcttttccatccttccagccactccttctgcaatagcgccatcatcaccttcatgcgtgcaccacctttagatagacgtcttctagagactccgttttctgttcaaatcgggtgacggtcaatccctttcggatacagtcacttaataatgaccggccaacgtgtatatcaggcagctcgaaaacagcttgggacggatttttatagacaatagctgagacgtaaggcttctcttcaagccagccttccagcttctctttcactgaaagggtaaaaacgttcgtttgctgctgttgtttcagctcctgtaactcgcctttccatgaaatttcaccgtttttcataatcaccacttgatcacacacctgctctgcatcgtgcaaaacatgtgtagaaaacagaacggccatatgctttttcagctcccgcatcatgtccagcacctcgaaccgccctgtcggatcaagtgcagacaccggttcatccaatatcaaaaacttcggtttatggagcagtgcctgtgccagaccgagtctttgtttcatgcctcctgaatagcccccgatccttttgtgcgccgcttcgtgcaaaccgacaaattccagcatctcaccgatttcctcttggcattttctcttcgaaaggccggacagtctccccgcaaatgtcaaaaattcatttgcggtcatccacgaataaaaagcaggatactgcgggaggtacccaatcaaacgccgatccagctttttctctcctaacagctttatggttccagaggttggcgaaagcagtccggccagcatttgcagagtcgtggttttgccggctccattaggtcctaatagtgcgacacactcattttcattcacgtgaaaactgacattctttacagcttcatgatgcctgtacgatttgcataatgattcaatagacagcatatcggcttacctttgctttctgccgacggtaaaaaacaaaatcggcccgataatattgatacatacgatgattgcagcccacatccactttggcccgttcgtccgctcttcttttatacagctgatgagggcaaaaaccgccaaagccagctgtaatacaaccagcggcaaaatcatttcccaagaaatattcattgcttgatcccccttttcttccgatctggcctaatgacaaaaaagtaataacaaattagaggcatcggtgctgtaatcagtccgacaattccccaaatccatgccatgcgatttcgttttttcgcatcaataaataaaaagattccctgcgccaatacgatgagataagccgcaaccgttatgacgatttctgtttgtgtcatctgcgtttcacctcgcattcgccgagatgcctttttttctcagccgcaatcaaaatcggcagcaccgcaagcacacaaacctgaagcacaataaacacagcaggagcttgagtgaaagcatagattgcagcactcacaaccatcagtgcgcagaatacaaataaaatgatctcttgaagaagtttttttctgtattcagctttcatttgtgacagctggtgaagcagttctttttgattcggtatagagggattggctgtttgatcaatttttttccattctgacttcaaatgatctgaaagcttttctttattcatcgtcccactcctttctgatttgctggagccctttatgaactctggactttacagtgccttctttgatttgaagcatcatcccgatttcggcgtaggtatagccgtagtaatgccttaataaaactggtgtgcgcagtttagggtccagctttgaaaacagatcgagcgtttcgctccactctgcccctttcgccgacacgtcccacttgatcttgcggattgtttcctccgtaactgtctgattccgtttccattctctctttctctttttctggtgatcgagatagagccgcgatgcaatggagatcagccacgtggagaattttgaacggccctgaaagcttcttaaatggatgtaccctttcagaaaggtttcctgaacaagttcctcgctgagatcggggtgaagggaaagctttaacaagtatttatataagaaagaatagtgatagtggaaaagggctgtaaacgcctcgtcgtttccctctttcgcctgctgtatcagccgctgttcttcttgtgtatccaatgaccatgatccccccttttttgtttttctgccttatgagacgacaccggattcaaaagcgttcatcttttttacaattcttttcagccattgacagatcaagcttcccggccgtttggctgcatatccttatttgtaaaccccctcatagtctgttaagctatgactttatgtcgatttcaaaaaaacatccaatatggaggacgatgcattgaaagtagaaaggcgaacgattgaatatattccgaatgaagaaagacatggtaaagcgaaagatttatttcccgtatggttcggggctaatatgcatatcaccacgttagtgaccggcacgattcccgttgcaatgggacttaatctgttttggagtgttgccgctattatttgcggaaccttaatcggtgccatatttatggcgtctcattccgcgcaaggccctcagctaggcatcccgcaaatgattcaaagccgtgcccaattcggcgtaatcggagcgattcttcccctcttcttagtcatgtttatctaccttggtttcttcgcaagcagcacgattctggcggccggaaccttaagcagctttgttcccatcccgggaacatggagcattataggcttaagcgccgtatgttttttactcaccattttcggccatgatttgattcacaaaatgcaaaaaatcctttcttggacctcttttgctgtattttttgctgcaacgattctcatttttcaattgccgattccggcaggcagctggattcccggagcgattgatctgccaattttcttggtggcagtcagcgcagttgcgacgtggcagcttgcctacgcgccgtatgttgccgattattcaagatatctgccagttaaaacaccggcttcaaaaacattttggtacagctatgcaggtacatctgtcagctccatctggatgatgctgctcggcgcattgctgacaacctcacttcctgactttacggcaaactcaggcagccagattgtccaattgttcggtcccttctcgtttattatgctgatcattgtgttatttgggcaaatggcaatcaatgtttttaacctgtatggggctttcatgtccacgacaacaacgctggagccgtttctgaaattaaaagtcacgcccaaagtcagaatcatcatgatcctgggtgtcacgcttgtcggcacagtcttaagcctactgggacagagcaattttatggaactgtttttgaattttatctttttcatcagttatttcttaattccgtggacggcaatcaatttagtcgattactacttcgtccgccacggaaagtatcaagtcaaagccatgttcgacgtaaacgggccttatggaaaggtcaattggatcaccacaattgcgttcgttctgtctatcttgctggaaatcccgtttatcaacacaagcttttacatcggaccgcttgccaaaatgtttggcggcggagacatcgcatggattatcggcttggccgtgccttctgtgctttactatgcattaatgaaaccgcgtctgaaaaaacgggcggggtatcaagaaaagctgtcttctctctgaagacagcttttttatcattcaaatcgtttccacacgcggggcaggatgtcagatagctcatgagcgagcaacgtatgagcggagtgctcgtccgtccagagctcggcgcacgcaccatgcaaatagaccgcgtttaatatggcgtgctttggatcttcatggcagcagagcatccccaatatcatgcccgtcagtgtgtcaccggttccgcccttggcgagcgccccgtttccggttggattgagccagcagtctccatcaggaaacgcgatgacggtttggtttccttttaacacaatgacagtctgcagctgagccgcccactcctttgcatattccgctctttttttctgcaattcgttcacgggcacccctgtcattcgggaaaactcgcccgggtgcggcgtgaggatgacgggggcctcccctttcggatatgtgcgcttcgccagcgctccggcatccaaaataacaggacaatcagccgtaagcacatgatcgactgcctgctgtacgctttccgtttgcggaaggcccgatccgatggcaatggctcggtacgtctcttcaagctgagcatccgccgcctttttccagccgtcacgccaataggtcgcctcgggcaaaacaggaacaattagcgggattacgctttctgatgtaccgatgacaagcttgccgagaccgctccgcatggccccaagccctgcaagcagcgctgcccccggcatgtcgtcacttccagccagcagcaaagccgtaccgtacgtgcctttatggctctccgcatctctttcaggaagcgtggcccttacatgctcttccgtccaaaatggaacattcatctctatccctcctctgctttcttttcctatttttcctgtcccttttctttttcaaacaaaaaagacagccttttagggctgtcttctattttacaggaacatcaaggtgatatagacggcgatatcgttcgtttgccgccagcagctcctcatgggttccttccatttctgttttgccgctttcgagaaatacgattttatcagccgcttccactcccgcgagatggtgggtaatccataaaatcgtttttcctttcagcacctcaaacaccgtttccatcaattcacgttcggtaataggatcgaggccgactgttggctcatcgaggatgatgatcggtgtgtcctgcagcaaaatcctcgcaagtgcgatccgctggcgctctccaccggaaaaacggatgcccgtttcctgtacagaggtatgatatccgtcaggcaatgactcaatgtagtcatgcagcttgacctgctttgcggcgcggcgcacatcctcgtcgcttgcatctccgtttccgagcctgatgttgttcaaaatacttgtatcaaacaggtgcggtttttgatttaacacggccaccgcatccgcaatctgatcctttaacagcgctgtctccactccgtttaacgttacagaaccggagtccggtttcaaggcgccctcgattaatgcaagcgatgttgatttcccagagccgcttcggccgagcagcgccattttttctcctttgcgcagcgtaaaggaaaagttgtcaagcacttggctgctgttgtcataagaaaacgtcacatcacgaaaggccaaggtgacatcttgaagatcgagcatttgatcccctgattcagtttgtggcgcctccggctgaggagccaccttgttcatgcgtctgatagaatcctgatagcccggcacttcgcctaaggcatccgaaagcggcaaaaaggcttccgtcaacggaaacaccactagcacaaaagcggcaatcatcgttttagcgagctcgccgtccgcttgctgtcccgctgtccaaaacagcatcagcaaaataaggccggcgacaaggcattgcgcagcaaagtcccgccatctcataaaacgttgttttttccgttcaagctcaaaccaatcatgttcctctttttcataagcatcaataaaagcatgccggcgtccgctgaacatccagtcgctgacacccatcacggcatctgtcagacggctgtacagcacattccgtccgcttttcagcttcgcattcttcgctctcgtcacgagcaaagacacaaccggaaacaatacaacaagaacaaacaaataaagcgcaagcaatatggcaaatggccaagagaagaagccgagcgctatcactgacacagcatacaggagcaaggctgagatcgcaggaaaaatcgtttttaagaaagcatcctgcaaatgctcaatatcctcagacaaaatgccgagcatatcccccgtgcgaaaacgggaacgcagcatcaaagcacccggctcaagcatattgtaaaggcggacgcgcatgtcggatacgattttcaaaatgatgcgatgcccgacgagccgttccacatatcgcgatacagagcgcgcaatcccaaaggtgcgcactgcgacaatcggcacataaatgagcagaatgttttccggccttgtcgccgctttagaaatcaaaaaccctgaggtgaacatgagaaaagcagcagaaaaaatcgtcaccgcgcccaaaaagataaccagaacaaacaggcgggcattttgcttgatatacggcaaaatccattcttctttcttcatgctctttcccccagttgtgccttcacgagtttggtatacacaccgtttttctccagcagttcattgtgagtcccgatttccgcaaccctgcccccgtccagcacgataatttcgtccatatcgagcatccagtgaaggcggtgagtcgcgagaaagacaagcttatcctcaaataaatccagcatcgtttcttttatttcatattctgtttcgatatcaagatgggcggtcggctcatccagcagcaggatcggacggtttcccaaaaaggcgcgggccagcgcgacacgctgtgcctggccgccgctgagcgcccggccgccttccccgatccgcccctctaatccttcaggaaggctatccaccagctccgccagtcccgccgccgcagcagcacgggctgtatcctctgccgaagcgcttggatggtagaagcgaatgttattgccaagcgtatcatcaaaaatgtacggatgctgggggatgtacagaaggttcttctgccagctgccgtcctgcaaatgggaccggcttgtaccattaacctcaatcatcccgccatccggctccaaaaatccgccgagaatatcaattaatgttgattttccggcgccgcttgcaccgataatgccgatatttttcttgcccttaaatgagagatgaatatcagacaccgaacggccgactgacacgcctgacagcttcagctcatcctgatcggaccaatcctcgagctgaagcggcgtctcttctttaaaacctggctgcgacaaaatctcttgaatggtttttcctgcttcctggccgttcagcgttgcatgataatcattccccacttcccgcaccggcaaaaaatactcaggcgccagaataagcgccgttaaagcggggccaagcaaaatatcgccgtcaataaggcgcaggcccagaaatactgcgactgtcgccaccgacagcatcgtgaaaaaatcgagggcgaatgatgacaaaaacgccacccggagtgtgctcatcgttgccttgcgataccgctcactcacatagaaaatatttttgctgtgtgacttgctcaaacctaggaaacgcaatgtctccagcccgcgaagagaatcaacaaaatgattggaaagtctctgataggatttccactgacgatccgcttttctctgcgcgacaaggccgaggagaatcataaagatgatcagaatcggcatagccgccactaaaatgatggctgatgtgcgatcctgaaaaaacacataaatgacaaccgccgcaggcacaatcgccatgctgaccattttcggcagaaacagctccaggtagcggcggaactggctgatgccttccatcgccagcgtcaccatttgccccgtcccctctttctttgcaaagcgggggcctaatcggaacagctgatcaagaaaactttttctcaaatctgctcctgtccgggcggcgtattgatagacgattttctgtcgcgccaccgtcaccccgtgccgggcgataaaagcgatgagggaaaagccgatcaccggaaaaagggaggtaatgcccttcccgttgaacagcccggttacggcctcactcagccactctgcctgcatgataatggcagctgtctgaatcagcgttaaacaagtaatcacggtgagaatttgcttcattcctttatatcgaaacaggtcttttcccattaataagtcataggctccttatggctgacgcgcttccggaagacataatagctccagatctggctgccgatgacgaacggcagtagcgttaatgctgcaattgacatgactttaagcgaataatctccggaagaagcgttagctactgttaaatcgtatgcgctatgaagcgagctgaccattacgcgggggaatagggaaataaagatcattcccacggtcagcgccagaccagcgcctgtcatcccaaatgtccagccgtcttttttcttgcgaataaatacagccgcgagcataaagcagatgacaatcaaaacagcgagcggaatggtaatctcgccgcggcgtgtaaacatgtctgtctgatacgcagaaagggccgcgaaggcaagaaccgctacaaaaacaacacccattatcttttgcgccattttccgggcgcggttttgcaaatcaccaatcgtacgcagcgtgataaacattaatccatgctggaagcaaagaagtgttaccgtcacaccgccaagtacagaatatacattgatataatcagatacatgtgcgtgaatgttcatgtcggcatcaatcggcatcccgcggaataatgtcgtgaacagcacaccaagcacaaacggaggaatcagactgccgaagaaaacgacccagtcccaaacctttacccattttaaatgatccaccttgccgcggaactcaaacgcgaccccgcggcccattaacgcaagcagcactatgacaaacggaatgtaataaccgctcagcatcgttgcataccagtttgggaatgccgcgaaaatggcgcctgcgccagtcaaaagccagacttcattcgcgtcccagaacggcccgatcgtgttgatcagcactctgcgttctaattcattatggccaagaaaacgggtcgccatgccgaccccgaaatcaaagccttccaaaaagaagaatcctacaaacaatacagcaacgagtataaaccaaagatcatgaagagatgccatggtatacctcctgactaaatggatctgttgatacaggcacatcatgatgattatcatgctccgcaccttttttaatctcacggataaacaagaagacaagcagcgcgcccagaatcatgtacatcacaccgaatgcgatgattgagaataacaaggaacccgctgttacgttaggcgacacggattgagctgttgtcatcaagcccatgaccgtccaaggctgacgcccgatttctgtcataatccagcccgcggaattcgcaagaaacgggaaggaaatcaaagcgatcatgatgcgcaaataccatttgctgttttcaagctttttgcggcggtttaaccagaggccgcctaatgcagcaaggatcatgacaacgcctgcgccaaccatgatacggaagctccagaatgtcgttttcactggcggaatgtagtcgccttttccgtatattttttcgtactcagcctgaagggttttcatccctttgacacttccgctgaatttctgataagccaagtagctcaaggcataaggaactttgatttcgtttgagcttttttcattttttgtatcgatcgtcgcaaaagcggtccaagcagcagggtcaccgctgtcttcccataggccttcactggcagccattttcatcggctgtgattccatcaagtgctcagcctgcatgtgtccgctaaggccgacgccaagaccggcacaaaggccgacgatcattgcgagtttaaaagattgcttaaagaacggcacttcttttttcttcagcagtttaaaagcactcactccggcaataaagaaagctccagtggcaagcgcaccgaaaataacgtgcgggaattcaacccaaagctgagggtttgtaatcaacgcgccaaaatcattcatttccgcgcggccgtttttgatcgtaaagccgaccggctcctgcataaaggagtttgctgttaaaatccagaaagatgacatgatcgttccgaatgatacgagccatatgcagagagcgtgaattttcttcggcaggcggtcccagccaaaaatccataatccgataaaaatagactccatgaaaaacgccaataatgcttcaatcgcaagcggcgcaccaaatacatctccgacaaaacgggagtaatcagaccagttcagtccaaactggaattcttgcaaaatccctgttacaacaccgactgcgaaatttattaagaataagtgtccccaaaactttgccattttgagatacagctcatttttctttacaagataaagagtctccatcaacgcaaccataaacacaagcccgatagacatcggcacaaacaagaagtgaaacaacgttgttgatgcaaattgtatgcgggctaataccaattcactcatgctttctcctccatttccggttaaaactgtaatttgctcactacttcacaaatagaaccgagactttgatcagtaattcacaaaatagacgaaaaaaatattgctcaatatttcacaaatgtgtcaaaaagtcatccaatatgatgcaagattgccagactgaccaaatgacacaatctctgactggttcatattaagtactttacaacgattcatttcaaaaataaagcctaaaatacctaaaaagtcccgccctatgtgacggatttttgtctattttgttgcttatttatgtcggctgctaggataaatgaccctttattatcgtacatcaacacatcgttccttgcgaacaaaatgcttgccccgcaccagcactcgtttctcagcactccgtcataaacagattttaggcaggatgcctcttttcatttgaaccggcaagtggagaaaagttgaatagtaaatttttaatatattaataatttcaattttttagtaaacttaacatagtgaacaatttcactgcatcaagaataggggaggtttttcaatgggagagcttcaaacacaaatgcaattgcaaacggatacaattcacgaaggggttcgaaaagagaattggtttgcgaaagccatgaatataaaagtaggcatcataccgcttcctgtgtatgccttgctgtttatattaatcactgtttttgttatgcatcacgatgtaaaaagtgacattttgacatccattgccgtcatggcgtttttcgggtttacctttgcccaaatcggcaaatcgataccgattgtgcgttctatcggcggcccggccatcctagctacttttattccgtccgctgtcgtgtactatcacctgctgcctaatgatatcgtcaaatccaccacagaatttacagaaaactcaaactttctttatttgtttatcgccggtattgtcgtcggaagcattcttggcatgaaaagagaaacactcgtaaaagcatttatgaaaatctttattccgcttattgttggttctgtcacagccgctattgtcggactggctgtcgggacattgctcggactcggatttcagcataccctgctgtacattgtcattccgattatggctggaggagtcggagaaggcgctatcccgctgtccatcggatattctgacatcatgcccatttctcaaggggaagcgttcgcacttgttctgccatcgattatgctgggcagcttgtgcgcgattattctagcgggattgctgaaccgcatcggaaagaaaaaaccggaatggacaggcaacggcaaagtggaccgctccgaagaagagtcccctgcgctggaggaatctcaaagcggacagcaaatgttcaacctttctttatttgcgtcaggcggtatccttgctgtttctttatacttagtcggcatgctcgctcacgattttttcggttttccggcacccgttgccatgctgttactggctgttctaataaagctgttcagattggtgcctgcctcaattgaaaatggcgcgtttggagtgtcccgcttcttttcaacagctgtgacctacccgcttctctttgcgatcggggtatccatgactccgtgggacaagcttgtcgccgcttttaacctcagcaatattatcacgattctgtctgtcgttgtgaccatgatggccgttggcttcttcactggaaaatggctgaacatgtatccgattgaaaccgccataatcaatgcgtgtcattctgggcaaggcggcacgggtgacgttgccattttaagcgccgctgaaaggcttgagctaatgcctttcgcccaagtgtctacccgcatcgggggcgcgattacagtatccttaaccttattgctgctgcaccagttttattgatccccgcaagcaagttcttcgtcaaacgaaagagcttgcttttttgcatgtccatatttttgcaaattcccgcctcatgctatagtaatagttggaaatactagatagaaaggaatatggcatgcctatgggaactcatctatttctctttatgcttctcgggctgggattttatttgatatcagccctggctgcaaaactcattccggccatagacttctggattgatattgttctatgggtcggcgctgcagtttacatcttctctcatctctcattcatggacggcattgtctcaatcgcgacaatgttctactgctattggaccgcaatggatctcattgtttcagagcgtgtggaaaaaccttcgggagactggcaggaaatcgagctggccagaaacaaaacacgtctcctgtcagacattacgctgaccgccattgtgtttgcaggggctgttatttttttcatctatggacctgacacaagccctctcaaatatgtgatccttctcggcatgatctccggcggaggggcactggtgaagcgtatactgaatgttttcagcgtaaaggttttttattcagcagccttagaaaaattgcatatcagctcacactatgaaacccgtacatacccgctttccgatttgaaggacattcagcttgaatcaacggctgatctcttaaagctccatccgcttctgacgatgtattcatcacgtctagatttaacaacaagctttcagcaagtcattaaactgtctcttcccggcgaaacactgtttttgacggtgaaggaaccgcaaaaatggaaaacaattctccaggagtacacagatgcagaaaacgatgtggacaatgtaatttctgttttgccgttttatcatagaaaaaatgtgaagcggctgctcggtaagctttattttgccgccagcgtaagaggggtatccgcttacgccttattggtgctcgcgttatacgcattacacgcctctccatgggtcatggctgttgccgtaatcctgtattgggtattcaacatgtatatgtcagaccgtgtgttgcgggcggcgatggacgccaagccttgtcatcatccgcatgtacaggcagcggccgataagatttttcgatcggccggcatttcccatgtccgcatatacgaaacggagagtgatgattacaacggaatggcagtaggcatgaatgtcgggaggtcaatggtcatcctgacaagcgccacactaacacttccacagcgtgtcattgaaggcattctggcccatgaggcgattcatatcaaaaaacgtgacgttctgtcatcacagcttttgcgttttctatatcttggagctgtcgttgggattttcctcttgtttgagcagcatatcacccatcccgaggcccacaaaattgcgctttgggctttcattatggcaatcattatcctgttccagctctatcaatccttttgttcacaatggatggaggtgcgtgctgacaatcttggcgcatcattgctggagggcggttacaaacaaatggctgaagccttgaaaatcttggcggttcggcaggatgaggacatacagaaacaaagtgcctacagctctgaagcaggtgaagaagagcttcaaattgactctctcacccgtgataaaagctggtttttcagattgattgattttcagttcgctcctcatccccctatgtattggcgtgtcggcactttattgtcaaacaaaggacgtggggtgctaaagcgctggctcagagaccgcctgaaagaatcaatcactttgaaatgaaaccggtcagcgtttcatccgtataacagatatggtgaaaaaagggagtgaccagaagtgatagtgatcttattgataatagctattattgtttttctttcagtcattcagccgcagtcatcggataataaaagccgccagcaggcggacagcgggtatttcggttattcagatcatagctcacaccatgatggatgcagcagtgacggaggtttcagcgattccggctgtggcggcggagggggcggcgattaaacgccgcctttttttatttcattgattcgatgtacgcaccaaaagccgagcctgacatgcctggggacacgcgcacacgatggagggcatacattccctggtctctcgaagccgcgcccggttctgtcgtcacgcccatttgatagcctgttttttcagcggccttcagcgtctcctcattgtagcgccctaccggatagctgatgatggtggtttgctgatgaaacatgttgtcaaacagctttttcgaatcagccatctcactttgctgctgttgaggcgttaatccgttcagttcaaggtggtcaatcgtatggctttcaatcgatatgccgtgctgtgccatttccttcatttgttcctctgtcagatggtgcttatgtccgatcgatttgccgatcataaaaatcgttgccttcatcccgtactttttcagcaccggatacgcatcttgataattgtcggtgtacccgtcatcaaatgtgatcagcacgcacttctcactcggttttttatcctgcgtcagcatgagatacgcctctttcggcgttaatgtctgatagccgttatcatgaagccacttcatatgcgcctcgaattctttctttggcacacggaggctgtttcctgaagaaatgctgtggtacatcaaaatcggcagctttgccggtttctctgttttgatccatgcggatgtatcgtcttcttttttctgaacttgtactgccttttcttccggtttcttttgttccgcttttggcatcggctgctctgcattcgcctcttgatcagcgcaagccgcaagcgccaaacagctgcccaaaagaaagacgcttaaaaacaatcgtttcatcgttctcctgctttctgtctatttcttcctcctttttcatcggtttgattctgagattttcaatagcaaaaaaaccggacatgtctccatgtccggttttttgatcttatcggattctcacttctgtctcactgtcaaagaaatggcctttgttcatatcaaatgcgaccgtcagctcatcgcccgattgaatatcgaggcgggcgtcgatccgcgcaataaagtcttggttgtcgatctgcgaataaatcatgatttcagaaccgagcagctctgcaacattgattttcgccttaatcgaagagttcttatatgattccacgacaatcaattcatcatgtatatcctcaggacggatgccgaagatgacctctttgccgatgtagcctttttcacgcagcactttcatttttccttccgggacggttaatgccgcagaaccgattttgattaagccatccgtaagcttccctttgaaaaagttcatcgccggtgatccaataaacccgccgacaaagacgttttcagggaattcataaacatccttcggcgtcccgatctgctgtattttcccatctttcatgactacgatccgtgtcgccatcgtcagcgcttctgtctggtcatgcgtcacataaatcgttgtagtttgcagtctctggtggagcttaatgatttccgcccgcatttgcaccctcagcttggcgtccaggtttgacaaaggctcatccatcaggaacacctttgcatcccgcacgattgcccgcccaagcgcgacccgctgtctctgtcctcctgacagcgctttcggtttgcggtgcaagtattcctcaagcccgagaattttagcggcttcctctactctttttttgatttcaggcttcggcattttccgaagcttgagcccgaacgcgatattatcgtagaccgtcatatgcggatagagcgcgtagttttgaaataccatcgcgatatccctgtcctttggcgctacatcattaacccgttttccttcaatataaaaatcgcctttcgaaatttcttcaagtcctgcgaccattcgcagcgtcgttgatttcccgcagccggacgggccgacgaatacgataaattccttatcggcaatatgaaggttaaagtcatcaaccgccggttccttttgatcataaaatttataaatgtgctccatccgcaattcagccatctaacatccccctttattattgtaatcgctttcttatattgagtgtaacagcaattccctctcgctaaaatgggcagcgttcataaaatcacccagccatttttcgtgcatatttccaatttattctgaacttttattttgcaggcagataaaataggcaagaagcgcgcctttgtacgatttgatatctatccctgaccgctcaataaatttatcaatccgatattgcaggctgttgcgatgcagatgcagctttttcgctgttaatgtgacgtttgagttgttttcaataaacagcttaatggtcttccttagctcagcttcacttccaaataaaagctcagcttcttcagagagcagcgtttccagtttttctttttctgtttctaataatagaaaaggaaagatcatctcaaaggtcacactctgcacctgaggcagccgtttttcagcaaacaggaaatacgcctgttcacgagcgaaatgttttcgcagacactcatccggctcgtaaaatcttccggcgtaaaaacggacactgaagtagaaatcactttcaagaaccttagcaagcgattccagttcgtccttctccgccgtcgcttcactttcctgctcgacaatcacgcctctgtcctcatggatccacacaatcacaaaagacaccggccaaaaatggcgaaccgcttccgtaaaggacgtcctttctattttgccgaataaatgaaagtgaacaaatctcgtccgtttctttatatacgccggcaattcccctctggaaaaaaggaatgaaaaccacttgttttcctcaggtgatttcatagacagttgattgccctcatccgcaggcgtcaaaaatgactgcagcaccaatacttctttttcactgatctctgttttcggaatggagatatatctctgattgctctcatcaaaaaaacatagacagccttcccttatgcaaagctcctcagacacaatcgaaccgggataaatagccagcagcgatttcatagagtctcctctcttatgtaaggatctgtatattcagtataaggcgaaacacacatgttctccactaaaaaagagtatatccggtatagatagacgagaaactgaaagggaaacctcattcgtttacatattggcttcagcggaaatagaagaggatatgcaggaccaaaggagggtcatcttatgagtttcgaaacgttaaacaaaagttttatcaacggaaaatggactgagggagaaagcggacgtacggaggacattttgaatccgtatgaccagtctgtgatcacaacagcatctttggcaacgggcaaacagctagaggatgcgtttgacattgcacagaaagcccaaaaagagtgggccaagagcacaacggaagaccgaaaagccgtcctgcaaaaagcgcgcggctatttacaggaaaaccgtgatgacatcatcatgatgatcgcccgcgaaactggcggaacgattattaaatcaacgatcgagctggaacaaacgattgcgattttagatgaagccatgacgtatactggtgaattaggcggcgtcaaagaggtgccatccgacattgaagggaaaaccaataagatttaccgccttccgctaggtgtcatttcatcgatttctccatttaattttccaatgaatttatctatgagatccattgcgcccgcaattgcgctgggtaacagtgttgttcacaagcctgatatccaaactgctatttccggcgggaccatcattgcgaaagcgtttgaacacgccggtcttcctgccggtgtccttaacgtcatgctgacggatgtaaaggaaatcggggacggcatgctcaccaatccaatcccgagattaatcagctttacgggatcaaccgcagtcgggcgccacatcggtgaaatcgccggtcgtgccttcaaacgaatggcccttgaactcggcggcaacaatccatttgccgttctttcagatgcggatgtcgatcgtgctgtggatgccgcgattttcggaaaatttattcaccagggacaaatctgtatgattatcaacaggatcatcgttcatcaagatgtgtacgatgagtttgtagaaaagttcaccgcccgtgtcaaacagcttccgtacggcgatcaaaccgatccgaaaaccgttgtcggcccgctgatcaacgagcgccaaatcgagaaagcgctagagatcattgagcaggcaaaggcagacggcattgagcttgcggttgaaggaaaacgtgtcggaaacgtgctgacgccgtacgtctttgtcggtgcgcacaacaacagcaaaattgcacaaacggagctgtttgccccaatcgcgaccattattaaagctggcagcgatcagaaagcgattgacatggcaaatgatactgaatacggcctcagctctgcggttttcacttctgatttagaaaaaggcgaaaagttcgccctgcaaattgacagcggcatgacccatgtcaacgaccagtccgtcaatgattcgccgaatattgcctttggcggaaacaaagcaagcggtgtcggccgcttcggtaatccgtgggtcgtcgaggaatttaccgtgaccaaatggatttcgatacagaagcaataccgcaaatatccgttctaaatgaaaaaatccctctgcttcaagtacagagggatttttctttatttagatatatccacaaacccttcgccaaacacatcgcgtacgtcatgaacgatcacaaacgcttttttgtcgcagcttctaatgatttttttcagcatagacagctcctgtttgttaatgacgatatacaaaatctcttttgattggcccgtataatttcccttccctgataaaatcgtcacgccccgatccatcaaggtatttacctgctctgcaatctcactcttattttctgaaatgaccgtaatggcttttttcgtattcaaaccttcaataatgaagtccatcactttggtaccgatatacagcatcacgatcgtaaacatcattttttctgcaccaataataaaataagagctaaatactacgattaaatcaaaaaacaagagtgcatagctgatattccagtctaaatatttattagcaattctggccagaatcgcggaaccggccgtcgtcccgccgacccggataatcatgccgatcccgactccggcaaatacacctgcgaaaatcgtattaatgatcaattcatcagacggaatgctccacccatgtgtcagatgaagaaagagcgaatttgccgcaaccgcaatgatcgtataaaccgttgtttttccatcaagaaacttgtagccgattaaaagcaaaaacgcatttaagataaagttcgtgacaccaggagaccattgaaacagataatacaaaatcagcgtaatcccagtgactccgccttccccaagatcattgggaatcgcaaataaattaaccgcaagcgcgaagaaaaaagcgccaatcacaagcataagtacatccagcattctctttttcatcacgaaaacactccttctcattgttctgttctagcaaataaaaaaacccaggagaacgctctcgaaaaagagcagaaactcctgggcttttatcccaccgtgtcataacagccaagctgctatgtgttttctctcggtcacagtccaatttgcattgcggaaccctagaaaaccactgtttttatcatatccttttcactttccaatattagcattataagggacggttcgaattggttcaaggggtatttgcggagttttcatcagataagctggaagaaaatacgatttatctattaaaaaagaacagatataaccgataagaaaaaaagcatatattttacaagcgaatgtaactataaatgataataattataagaaattcataattttatattgactaagtgaaataatataggcattatagtacatatgtttcgtacattttattacataggaggaaatataatggcaggaaaactagtaccctgtaaagcttgcggtcaagaaattgcaaagggtgtaaaaaaatgtcctaactgcggtaaggatcaacgtaacttttttatgcgacataaaatcattacgtttattctcgcagttgttgtcatcattattatcggtaatatgattggcggcggaggcggctcagaagccacttccaaaacatcaagcagcagcaaagcagaaactgaaaaaacatacaatatcggtgataccgtaaaaactgaaaaaactgaagtaacagttacgaaggtagaggacagagatactgtcggtactcaatatgttgaaaagaaagcatctgatggtggtacaattgtagcagttcaatatacaattaaaaacgtatctaaaaagccgattagctctttttcaattccaactgttaaattagttgatgctgatggcacttcttatgatgctgatatcgatgcttcttcaacctatgcaactgagacaaaagttgacaactctaaaatattaagtgatctaaatcctaatattaaagtaacagatgtgaaagcatttgaggtggacaaggaagcttatgcaaaaggcacttggaaactaaaattcagtaatgatgttattgtgaaaatcaaataacagctaacaagggtgcctgttcaggcacccttgttctttaaaaaaggccttctctattgagaaggcctccattcttattccgcactcttatacccattcacattagaagactgccatctccaggaatcagcacacatttcctcaaggccgcgtttcgcttcccagcccagttcccgcttggctttcgcaggatctgcaaagcatgtggcgatgtctcccggacggcggtccgcaaaacggtacggaacctctttccctgacactttttcaaaggctttgaccatttcaagcacgctgtagcctgtgcctgttccaaggttgtatgcatcggctcctgtagagttcaatactttttccagcgccttgacgtggccttctgcgagatcaacgacgtgaatataatcgcgtacgcctgtcccgtcttttgtcggatagtcatttccgaatacgcttaattgctcgagcttcccgactgctacctgtgccacatacggcataaggttatttgggattccgttcgggtcttcaccgatccgtccgcttggatgcgcgccgaacgggttaaagtaacgaagcagcgcaacgctccactcattgtcggctgtatgcaaatcacgcaatatttgttcaagcatgagcttcgtctgtccataagggtttgtcgcacctaatggaaagtcttccgtaatcggcgatgtttccggaacgccgtatactgtcgcagatgaactgaatacgattttcttgacgccgtatttctccatggcctcgcataaaataaacgttcctgtcaaattgttatgataatatttgaggggaatcgcaacagattcaccgactgcttttaaccctgcaaaatgaatcacagcttcgatttcattttcagcaaaaaccgcatctaccgcttcccggtccaataaatccgcttcgtagaacgttaaatcttttcctgtaatctccttgacacggttcagcgcttcagctgaactgttggacagattatcaagaacaacaatctcgtagccgctgttcaatagttcaacacatgtgtggctgccaatgtacccggcaccgccagtaacaagtattgccatgatttaaaccctcctaaaaaatgacctgttttcattatatagtgtttagaaccggtccacatccatttttaagaagtttaatcgtttattaatagtttcttcatatattatcagcattttcatacctttatgcagcgcgaacaagtatagcagctgaaaaatcaatctgccggttgacgttttcctttccctttttcgctatgcttaatgcagaaaggatttgatgacatggcgatgagcccatatatttttattgtattgattcttattattttatcgatgtaccgagagagagctgtcagacccgggaagttgctgatcattccgctgctgctcttatggggcgtatcagcatcgtttcagccggcgtattttcattccgtattacatgtggcgatcagcggcattttattattgatcgggctggcctgcgggtttggcattgggaagatggtaaatgtacggattcacccggaaaccggaaaggtcacttcacgcggctcacttgggagtgttatcctcattctagtgatactttctttgcgcatggccgcgagaacatggctgcctgagagcaacgagatgtttattgccattattcattctatgttcttcgttcccctcggcaccatcacagcccgcaacatcatgctttacaaagcatacagacggctgaccgccggcaaagtatccattcaataaccgaaagaaggaccagcatgaacggacaaactccggctcggcactactacaagaagcttgtgccgagccttattctcattttgaattgcatacaatttttatctcatccaactaaggctgatcccattttgttagcatttgtatttgcggtatacttagcattcatttggatcattccctatgtggcatccaccgctgttagtttgagcatattcgtcgggctttggatcctgaccgtttttctttgggctgtttccggccaagagcagggagccgccttttttttactcgtatttttaatggtttatgcagccataaagcttcctgcacggctgtctttgatccttacagtgtgcctaattgggggcaatgctttctttttgtattctgtttttgacagcagctgggacgatatcatcagcaacatctcgatcatgatcggactctacgtcttcttctcctccatgcgtttcagacgagaagcgagaaaggaggctgaacggaatcatgctgaattggcaaaaatgcatgtgcagctggagcatgctcataaagaactccagaaagcgcatgcagagctgcaggaggcttctgttctttcattaaggtacgcggtccttgaggaacgtacaagaatcgcccgcgacattcatgacagtatcggtcacgagctgacttctgtgattgttcagcttcaatctcttccctatatcctcaaaagcagcaaggaggattcagaaaaagtcattcaaaatgtactgagtgtcgccagggaatgtcttcaagaagtacggtctgtcgttcaccaaatgggccgtagtgaatcgatggtggggcttaccgctttgcgggggctcattcatcaagtggaggaacggagcggcttgcacgtttctttagatactgccggactgtcagaagagtcttggcctccaaacgtgagcgaaacgatctaccgcatcttgcaggaagcgctgaccaatatcattcgtcacgctgacgcttctcatgcggcggccgtcatttctaacgacaagtcccatctctatgtcacagtcaccgacgacggacaattcaccggcagccttacttatggatttggcctgacaggaatgaaagagcgcgcagaaaaagcaggcggttcccttactttcagtgccgtacagccgagcggcctgaaaattgagctgtcattgccgctcatgacaacgcataaggagcaaaaagatgaacaaagataaaatacacgtcgcgcttgccgatgatcagccgcttgtgcgtgaaggcttccgctacatcatcaacgcacagccggatatgacggtttctggtgaggccggcgacggttgcgatattatagcactcgcaaaacaaacaaaacccgatgtcatcctcatggatgtccagatgccgcattgctcaggcatcgaagcggcgaaagacatcatatccgcccttccagatacaaagattgtcattttaacgacctttgacacggaggaatacgtatttgaaggcatccgtgcgggcgcagtcggctatctgctgaaggatacacttcctgaagagttgatagatgcgattcgcgctgcggccagaggcgaggcgattttccgtacagtcacagctgctaaaattatcagtgagacatttcgggcgaagcaacagccccatccagaagaactggcagagccgttcaccaaaagagagcttgaggttcttcagcaaatggcctacggactgagaaatgaggatattgctgaaaagcttttcgtcagtgaaagcactgtgaaaacccacgtgcaccgcatcctgcaaaaatgcaatgcccaagaccggacacaggcagtcgtttttgccattcgaaacggtattgtgcaatagaaatctctcatcccgccatgctaaaataagacaaaggagatgattggaaatgaaagaagaaatcattgaacggtttactacatatgtaaaagtcgacacacagtccgatgaatccgttgacacttgtccttccacacccggccaattgacattaggaaacatgctcgttgatgaattgaagtccatcggcatgcaggatgcagccattgatgaaaacggctatgtcatggcaactcttccctccaacactgaaaaagacgtgccgacaatcggctttctcgctcacgtcgacaccgctacagactttaccggcaaaaacgtgaatccgcaaatcatcgaaagctatgatggaaaagacatcgttcttaacgaaaagctgcaggtcaccctgtcacctgatcaatttcctgagctgtccggctataagggccatacactcatcaccacagacggcaccacccttctcggcgcagacaataaggccggtatcgctgaaatcatgacagccatggattacctcatcaaacaccctgaaatcaagcacggcacaatcagagtcgcctttacgcctgatgaagaaatcggaagagggccgcacaaatttgatgtgaaacggttcaatgcatcctttgcctacacggttgacggcgggccgctcggcgagcttgaatatgaaagcttcaatgccgctgccgcaaaaattacgattaaaggcaacaacgtacatcccggaacagctaaaggaaaaatgatcaactctgcgaaaatcgcgatgaagctgaacagcctgctgccggcagacgaagcgcctgaatatacggaaggctatgaaggcttctaccacctgctgtcgattcaaggagacgtagaggaaacaaagctccactacattatcagagactttgacaaagagaatttccaaaacagaaaagaaacaatgaagcgtgccgttgaagaacttcaaaacgaatacgggcaagaccggattctgctggatatgaacgaccaatactacaatatgagagagaaaattgaacctgtcatcgaaatcgtcaacattgccaagcaagcgatggaaaacctcggcatcgaaccgaagatttctcccatccgcggcggcaccgacggatcgcagctgtcctacatggggcttccgacgccaaacatctttacaggcggggaaaatttccacggcaaatttgaatacatctcagttgataacatggtcaaagccgtaaatgtcatcgttgagattgcaaagcagtttgaagcgcaagcataatgccaaaagccagtccaaaaaaggactggcttttttgtgtgaaaatgaaacattttaaacgcgtcctccgtaaaacaagtatcaacaaatgaggaggaaaaacaatgacaaaacatgcaatcgctgcaaagagtctcttgaaaaaatggatcatttccaggccgcttaacatgcaaaagaaatccagcccatttcaaaaaatcagaaaaatgttcaaacgcttcttcaaataaaacattcaaatcccctaaatacaatccctattcacccgtaccgcccaaatgctccgtaatttgggttttttgtgttcaattccgcaaaatagggtataaaccaaacaagcaagaatacagcacccaaaaacaggcaattcgaattacgcaaacttaggttaaaagttatataaaggaatttattttatcgtcgatagtaactatagaaccaatcatcaacaagagcaaacagcgtgattcaagactattttcaggtcatcaggttatactgttttagagggacagtttcttgttatttattgatttagaattttttgaatactttttgactttttatccgtacaatagagagtaccaaaactttttttgggaggtatgtaatatgatcctatttattatcatcgcattatgcggctatcttcttttttctttcagcaaggacaatcgccgcaaaccgcaaaagacaagccctctgccagcagccgcacctcatcacaacaacctaatcgaccttgacgccatccgccaaaaacgccggatgcatctttcctaattctatatttcaaatgaaaaggctgctgaatcacgcagccttttaaaattgttttgatttagagcctgaaaccttttcgccacctatccgtaatttcatacaaggcaaacccaaaggagacttcagcaatgatcgagttatttatgaaacaaaaaatgttctcatttaaagatgcatttcacatttatgaccgggatgaacaagaaacattcaaggtggaggggcgttttttctcgttaggagactcattacaaatgacagactcatctgggaaaacgctcgtttccatagaacaaaaactaatgtctttattgccgcgctatgagatttcaattggcgggaaaacagtttgtgaggtaacgaagaaagtaacgtttttcaaaccgaaatttgtgatttccgggcttaactgggaaatcgatggtgatttatggagggatgaattccagctgacggacggggaaagtgtccggatgtcagtgagcaaaaagtggctcagttgggtgattcctatcacttgcagattgcaaacgaggaagatgttctgatttgcactgccatcgctatcgtgcttgatatggttttatataacgatgaagatgaaagtattttctaaaaagcattgacaattgatgcaaaagtaataatattaagataattgaaatctgaatatgaagttgtaccttatcaagagaggtggagggactggccctatgatacccggcaaccgctgtttcaaacagaatggtgctaaatccttaagaacattgcgttcttgcagatgaggcggagatttgatcgttcaagctcttccttcacaaaggaagagctttttacatgctcattatttcagaaaagaggcgaataacatggctcaacaaacgaatgttgcaggacaaaaaacagaaaaacaacacaaagcacctttccgcgccgatcatgtcggcagtttgcttcgttccgttccggtgaaggaatcccggcaaaaaaaagcggctggtgagatgacagcggaacagcttcgtgatatcgaaaatcaagagatcacccgcatcgtggaaaaacaaaaagaaatcggtctcaacgtggtaacagacggggaattccggcgttcttggtggcattatgacttcctagaaggacttgacggtgtggaaccgttcattccggctgagggaattcagttccataacacaaaaacgaaagcgcgcagcatcaaagtgacgggaaaactcgattttacgagccacccagcgcttgctgattatcaatttttacatgagattgccggtaacgcgacgccaaaattgaccattcccagcccaaatatgctgttttttggcgaaaaggcggataaagggatttatgacgatcaagaggaatattttcatgacctggcccaagcatacaaaaaagcaatcaaagccttctatgatgctggctgccgttatctccagctcgatgatacgtcatgggctctcttctttgaggaaaaaggcagagaggttgtccgggcgctcggcggtgatccagaaacattgccagccatatttgctaaaacaattaacgatgccgtcgcagaccggcctgacgatttaacgatcacaatgcacatttgccgcggcaacttccgctcaacctgggcggcatcaggagggtacgacgctgtagcggaaacgattttggacggcttaaaccttgacggccttttcttggaatacgatgatgaccgctccggaaactttgatccgctccgttttgtgaagcgcaaggatctgcaaattgtgctcggcttgatcacatcgaaatacggcgagcttgaaaatcctgaagatgtgaaacgccgtatcaatgaagccgcgcgttttgtcagcttggaccagctatgcctgagcccgcagtgcggtttcgcctctacagaagaaggcaaccttctgacagaggagcagcaatgggcaaagcttcgccatgtcatcgacattgccaacgatgtgtggagataatctatcattgacagaaatagaaaatgtgtgaataatagatactatcagaaaatttcataaaaaggttttccttatcaagagaggtggagggactggccctgcgatacccggcaaccgctgtttaacagaatggtgctaaatcctttagagcaatgattgctcttgaagataaggttgagattgtcacgcaagctcttccttatccaaaggaagagcttttttacatttgaatggaaagaaggaatggacaacatgtcacaacaaacaacacccgcagaacaaaaatcacttcaaagaaaaaaaccgccgtttcgcgcggatcaagtcggaagcctgctaagatctgagcccgtcaaaaaagcgcggctgcaaaaagcggccggcgaaatgaccgcagagcagcttcgccaaattgaaaacgatgaaatcatccgcattgtggaaaaacagaaggaaaccggcctgaacgtcgtgacagacggtgaattccgcagagcatggtggcactttgatttcctggaaaacttagatggcgttgagccgtttactcctgagcaaggcattcaattccataacgtacagacaaaagcacgcggcattaaagtcacaggcgatatcgacttttcaactcacccaatgcttgaagattactcatttctccatagcattgccggtgacgcgacgccaaagatgaccattccaagcccgaatatgctgtttttccgcgggaaattggaaaaaggtgcatacaaaaacgactatcaccttttccagcatgatgtatccaaagcatataaaaaagcgattcaagcgttttatgacagaggctgccgctacctccagcttgatgatacagcgtgggccgttttcttatcagaaaaaggcttaaaacaaatcgaagcgttcggaacaacgcctgatgagcttcgccagctgtttgcgaaatcgattaacgacgcgattgcagaccgcccggatgacttgacggtaaccatgcatatttgccgcggcaacttccagtccacttggacagcggaaggcggctatgacgcagcagccgaaaccatttttgacggcttgaatcttgacggacttttcttagagtatgatgattcacgctcaggcggatttgagccgctccgttatgtaaaacggtctgatcttcagcttgttcttggcttagtgacatctaaattcggtgagcttgaaaatccggatgacgtgaaacgccgtatcgaagaagcgtcccgttatgtaagcttagaccagctttgcctcagccctcaatgcggatttgcttcaactgaggaaggcaacaagctgactgaagaagagcaatgggcgaagctccgccatgtggttgagatcgctaatgatgtttggaaataagcaaagaaaaaacacacttgattccctagcggagcaagtgtgtttttttatgtcactgtgcggtgtagcccccatcaaggacgacagcctgcccagtgacgcccttcgccttctcgcttgccaaaaacacggcataatccgcaatttccttgacggaaagcagtcgcttttgcggcacaagcggaaaaatgacttgttcaagtacagagtcgtaagggacatttctagttttcgatagatcgctaagctgattgcgtacaagctgggtatcgacataacccgggcagagcgcattgactgtaatgccgtggggcgcgccttccagcgcccctacttttgtgagtccaatgacgccgtgcttggcgctattataagcggatttccctgcaaagccgactaatccattaacagacgcgatattaatgattctgccaaactgctgttttttcatgatcggaaaaacatgcttcattgcaataaagggggccgtcagcatgaccttgatcagctgttcaaaggtgtctgtcggaaactcttcaatcggagcgacgtgctgaataccggcattgttcaccagaatatccaagcggccgtattgtttttggatgacgttcaccgtatcagcaacttgcgcttcctttgtcacatcatacggaatggccgccgcgtcaaagccttcttctgcaagcttggaggctgctttttcacatgcttccggacggaggtctgaaacgatgacgctggcaccttcccgggcgaattctcttgccatttcgaatccgattccgccggcagcccctgtcaccaaggcgacttgttttctcatgtcaaacaccttcccattaagaattgagtacagactggcttacagcgaaatcagcttctgttttttcataaacctcttcaattgtgacaccatcctgaagctccgtcagtgtcatgcggccgttcacaaaatcaaatacagccaaatccgtaatcagcctgtgcacgactttctggcctgtcagcggaagggagcatgtttttttcacctttgattcaccatgcttattgacgtgatccatgatgacaacgattcgtttcgccccgttgacgagatccatggcgccgcccatcccttttaccattttgcccgggatcatccaattggccaaatccccctgctccgaaacctccattccgccgagaatagccaaatcgatatgcccgcctcttatcatcgcgaatgactcagcgctgtcaaaataagaggcgccggtcacttcagtgatcgtttcctttcccgcattgatcaaatccgcgtcttccgttccttccagaggataggggccaattccgagcaagccgttttccgactgaagcatgacgtgaacgccatcgggtatctcatttgcgacaagcgtcggcattccaatcccgagattcacattcatgccgtccttgatttcttgtacagcccgtttgaccattcgttttctcgcttccttcacttggcctcaccctttcccgatgcttgctgaactgttcgtttttcaatccgtttttcttggctcgcgccaagcacgacatgctgtacgtaaattcccggcgtatggatgtgatctggatcgagctctcctgcttccacgatttcttccgcctcggcaatcgtgatcttgcctgccatggcggcaatgggattgaaatttctcgccgttttcctaaaaaccaaattgcccatggtgtccgctttccacgctttgacgatcgccacatcgccggtaatgcctcgctccatcacataagtcctgccgccgaatgttttatgttcttttccctcggctatggaggtgccgacgcctgtcgccgtataaaatcccggtatgcctgcaccgcctgcacgaattctctcagcgagcgttccttggggaacaagctcgacctcaagctctccgcttaaaaactgccgctcaaaaattttattttcaccgacataggaagcgatcattttcttgatttgcttgttagccaaaagcaaaccaagcccccagtcatcgactccgcagttattgctgacaacggttaaatcctttactccctgatctcttatagacaaaataagctgttcagggatgccgcacagcccaaatcctcccgcgatcagcgtatccccatcatgaatcaatttcgcagcttccttgcttgatgacagcacttttcccatattgatgcccctttcgttttcttctacactagaccagtcaggctgtaaatcgcgatcacagcaaatacggcagccgttttaatgagcgtgatcgcaaaaatatcgcgataggattgccggtgtgtcaaacccgtcacggccagaagcgtgataacagcgccattatgcggcagtgtgtccatcccgcctgatgccattgaaatgacccgatgcatcacctctggcggaatattgtaagcctgaatcgcctgtaagtattgttctgacatcgcgcttaacgcaatgcccattcctcctgaagccgagccggtgattcccgccagcgcagttgtcgtaacggcgccatttacaagcggatcggtaaaagtatgtgaaattccgctgctcagcttatgaaaccccggcagcgcggcgataatgccgccgaacccgtactcggcacccgtattcatagatgccagcaaggcgccgccaattccttcattcagcccttccttcaattgggcaaacacacttctccaatcaaataaaatcgttgtgatgatgccaatcactaaagcaatctccaccgaccaaatagcagccgctgaagaaatatcaagcctgccgaactcctttaatcctatggaagaaaaatcaaatccattcggataccactttggcaggtaaatggtgaaatatttattcactgcaccaacgagaataagcgggacaaaggcaagcgcgtgccgaatcgggcttttgtccggttcagccgcggactcaatcgattcaggagcaggagcattctgcgaatcaaaaccgccatagccttcgccagatgcctgcgctttcttccgccttgattccaaatagagcatcccagctgccagcacaatcactgcgcccatcaagcccagccaaggggcggcataaatgtctgttttgaaaaacgacgtcgggatgacattttggatttgcggcgttcccggaagtgcgtccatcgtaaacgtaaaagcccctaaagcaatcgttcccgggatgaggcgttttggtatgtttgcttcttggaacatgtttttcgcaaaaggatatacggcaaatacgacaacaaacaggctgacgccgctgtacgtcaagacagcgcccatcagcacaatggcaagtatcgctctttttgccccgacaagccggacaattgttttcgcgattgatgccgcaagcccggccatttcaacgacctttccaaaaatggcaccgagcaaaaacactgggaaatacaatttaataaaaccagccatcttctccataaaaattgatgagaaaaaaggaagcacatggcttggatctgtcagcagcaccgcgaataacgcgcaaatcggcgcaaacaatatgacagaaaatccccgatacgccgtaaacatcagcaaacctaacgccaatagaatgatgatcagttccacacacacatcccccgtttccgcgaactagaaagcgtttacaaaaacctgtccgcatcggctgtttccgtcccctttccatatgtacgagaagcgtgggccaactattccgattaaaaaaggaaagctccttttttcggagctttcctctgccattcatttcattcctactaggatatcaacatcaaccgtaatatcggctgatttcatctctttcagcacgctgactcggtctttcggcgccgaccaggcaagcggcgtcatcttgagaagccagtggatcgcctgctggtcaagtgattttacatagcgcagcctgacaggatggctgtgcgccgcatgtgctgtaaaacgctcaacagctgccgcattggaatacgtgcgccttggtgaatcagcatataaaaattgccttaattctattaaatagtcgcttcgcggcactacttttacgagcatgccatcattcttcagcagtctatgaaactctgcataattggacggggaaaaaatagacagcacaacatcaaattggcgatcatgaaaaggagcacgcgccacatcggcaaccgcccacatctgatctttgaatgccttagaagcttttaagatcccatctttcgaaagatcgatgccggttcctaccgctgctttccctgcataatcaaacccgcaaagcgcattcaaatgagaaccctcaccgcaaccgctgtccaggatggtaaatgcctcatgaccagatttgggatgactgatgagttctgcaatcgcatcatggagcggctcaaaaaaaccacattctccaatcagcctgctcctcgcttcaaaaagctcagcaccgtaactggttttgaccggcttcgtcagaaagttcacgtagccgtgccgagataaatcaaatgtatgtcctcgttctgtacaaatcaagcttttccctgatgccgcatccatagaagaatcgcagagcgggcatcgaaacatgctgaaatcaactgttcgcttcatgataaaaaacaccccattcattcatttttagataaatgaaaaaggcatagacaaataaacctaggcctatctcaaaaattggccaggtctggcagtttgtctacacctgtcattatctataacgaatgaattggataatcatgaaaaaaactccctttctgctgtatgggtttccccatttccatcatacaacaaatctccaggagctggaatcttatggtgaggaaaaatcagtactgacatgctggtatcccgccaacatcatatcagcatagcaatccagcatgtttttcctttattttctcattttagaatataaattttattattgtgaaaatagttaaaaaggttgattttcaaaaagtgaaaggataaaatactgctatcatcttagaaaaagacattcttgtatatgatcagtaatatggtctgattgtttctacctagtaaccgtaaaaaactagactacaagaaagtttgaataaatttgaacgagttgaaaaggacaagttcttttctgtttgctcttatttttcacactttctgcacttccagaatttgtgaaggataagagctttttttgtttccataataaccctcataggagttgctatcatgtactttttactaaaccttgtcggtctcattgtgattatggcagttgtattcctatgttctccgcagaaaaagaaaatcaagtggcgcccgatcatgacgttaattgttctggaattgctgattacttggtttatgctgggaacaaaagtcggaagctgggccatcggtaaaatcggtgatttcttcacttggctgattgcttgcgccagtgacggtatcgcgtttgcctttccgtcagtgatggcgaatgaaacagtagactttttctttagtgcgcttcttccaattatctttatcgtcacattctttgatattttaacgtatttcggcattttgccttggctgattgataaaatcggatgggtgatttcaaaggcttcccgcttgccgaaattagaaagctttttctctattcaaatgatgttcctgggaaataccgaagcacttgcggttattcgccagcagctaacggttttaagcaacaaccgcctgctcacattcggcttaatgagcatgagcagcatcagcggctccattatcggatcttatctgtcaatggtgcctgcgacatacgtgtttacagccattcctttgaactgcttaaacgcgctgattatcgcaaacctgctgaatcctgttcacgtgccggaggatgaagatatcatctatacaccgcctaaagaagagaagaaagactttttctctacgatttctaacagtatgcttgtcggcatgaacatggtgatcgttattttggcaatggtgatcggatatgtcgcattaacgtcagcagttaatggcattcttggcgttttcgtacacggcctgaccatccagacgatttttgcttatctgttcagtccgttcgcattcctgcttggattgccagtgcacgatgcgatgtatgttgctcagctgatgggcatgaaattagcaacgaacgagtttgttgcgatgcttgacttgaaaaacaatctcaaatcccttccgcctcacaccgttgcggtggcgacgacatttctgacgtcctttgcaaacttcagtacggtcggcatgatttacggcacgtacaattcgatccttgacggagaaaagtcaacggtcatcgggaaaaacgtgtggaagctgctcgtcagcggaattgcggtatctttattaagtgctgcgattgtcggcctgtttgtgtggtagaaacattgagccatatcccttttcggatatggctcttttcattattgataaatagaggctggcacctgcacatcccggattcccgctgcataaggccccaagtcatactggccaaagacgatggcgatcccgtttgccgtaaagtaaaacattgtgtctttatttagggttatatcctctttctttacatcagggaaaaacagctcatcgtgttttttgatatagctatatagataatctctcgttttgctgacttttgttttggtgttcagaatctgatccagcgtcacccgcttttgtgttttcaagtcataattgaaggactggacagacgttaaaccgtgggcgccccctgaatagatataattgagtgtttgaatgctgagcttgcctgccgcattgtatttgacgctaaaggatgtttgatattccgttttaaagccctgctgttcgcctgcttttttgtttttcaggtattcctgatacgattgttcaatgtaggctttcagctcttgattgattttcttttcaaacgcggcattcccgatgtgatgcacttgtggatacgttaactccttgatctttttgtacgtatgagtgctgacagtcggtgttttcgtttgaactgcttttagagatggggccgcatatgcaactacggaaaaaagcaagactgcaatccccgcggctttcatcattttattccatttcatacaatctcctcctttgatgtcgttgtttatcattcccttatttaagcaatacacacttttatagactgattaaatcgaaagaagtttctaggtctaacagcatgatttttccaataaaaaaagagacacaggatgtctctttttttactgtttgcgcccaaaaatcgcttcatgaacggcctgtgctaaatctgtatttccgaacatctctaataccgcaatgacagtctggtccggaatgtgctctgcttcgtgttttggcacgaccagatcgtccatggtttttttcaagctttcattcagcttttgctgcggatacgctttggtgtacatctccaccggatcaagatcatggttcacgcaccattgggcaaacaccaaaatcatcatattttcatcgcgttcgtaagcttcagcgagctgtttttcgttcatttgtcatgctccttatgaaaagtatcttccttaaagatacaggagcaggtcaaattcgtctatcccaatggcgatgagcagcaacagcatcgataaatgccttgctgaaagcggtgtagtcaggttcttcttcagccgttacgatgcctggtccctctgttgtcccgacagaggattgaagaaggtcaattccttcatttgccgcaccgatcgccttgtagtgattgtaagcttctctgataaacgccatcgcttgtttgttgtcttttaactccagccctcctgcggcatagacggcatcatacagaacagaatcaaccgtcaggaacgtgccgctggcctcaagctgctgtccgctgccgcttgtcatataccccagattttggctgatgatatccactgtgattccttcttgctttaaggcttccagcactgtttgcagctctttttcatgaaatccgtttccggcgagtacagcgacttttcttgttgacgcggttttcactgtacgggcttggcttaacgcaggcgaagtaagaatttctttagatgctttacgcttcgcgggcgccgccacgcctactcctttggcgatttcttctgctaaatctgcatcgacattgctgaaaacatcaacgacctgccgctgtacgtccttgcttttgaccttcccgacctcgaagcagaaagcagaaatgatgtgctgtttctccacaggagacatgctgttccagaaaagcttcgcctgtgagtaataatcgttgaagctgtcgcttcgctggcggatttttttgccctcgactttttcctgatagtggacgtagccgccttcttcagctgtcgcaggcgacggatcattgttttgcagtgagtttttatgataagcaacaggccccttattgatcgtcatccgatgataaccgtcatattgattgttatggaatggacataccggccggttaatcggaagctcatggaagttcggaccgccaagacgaatcagctgtgtatccgtataagagaaaagccgcccctgcaatagcgggtcatttgtaaaatcgatgcccggcacgacatttcccgggtggaatgcgacctgttctgtttccgcaaacacattatcctggttgcggttcagcgtcattttcccaatgatcttcaccggcacaagctcttccggccacagcttagtcggatcaagaatatcaaaatcaaacttgaattcatcttcctcatcaatcatctgcacgccgagctcgtattcaaccttgccgccgttttcaattgtttcccacaggtcacggcgatggaaatccggatctttccctgcaattttctgcgcttcatcccatacgagagaatgcacgccgagcaccggcttccagtgaaatttcacgaaacgtgcctttccttgttcattgacaaaacggaacgtgtgcacgccgaagccctccatcattctgtagctgcgggggatgcctctatcagacatcgtccacatcaccatgtgggcagactcagggttattggcgacaaaatcccaaaacgtatcatgggcagtcgcggcctgaggcatttcattgtgtggctcaggcttaaacgcgtgaaccaaatccggaaatttgattgcgtcctgaacgaaaaacaccggaatgttatttcccacaaggtcatagtttccttcttcagtataaaattttgtcgcaaagcctctggcatcccgcaccgtgtctgcggagcctttagaacccgcaaccgtagagaaacggacaaataccggtgtcttcaccgaagggtcctgaagaaatttggcccgtgtgtactcggtcattggttcgtaaacctgaaaaaagccatgcacgccaaatccgcgcgcatgcacaacgcgctccggaatcctctcatggtcaaagtgcgtcattttctcccggaagtgaaaatcctccatcagcgtcgggccgcgaaccccggcttttaacgaatgctcatcctctgacacccgcaagccttggtttgtcgtcattttcttcccgctgttatcggtcctgtactgctcaagctgctcgtcctttgagtgttcatttacacgtttgttttggtcatcactcatgtctgttccccctttttaaaacgaaacattctacagcacatttacccgtggcgttcttcatataaactgctaatccgctcattaggatttttggtctacatataaatatgcggtcatacacatttgaaataagccttcttcacagaaagaagggatggaagcgcttaccaaaaaagctgttgaataggggaggtcatatcatgcttgccatactcggttttgtgatgatgattgtctttatgtaccttattatgtctaaccggctttccgctcttattgctttgattgtcgttcctattgtgttcgccctgatcagcggatttggcaaagatctcggcgagatgatgattcagggcgttacagacctcgcccctaccggtatcatgctgttattcgccatcctgtatttcggcattatgattgactcaggtctgtttgatcctctcattgccaaaatcttatcgtttgtcaaaggagatccgttaaaaatcgccgtaggcacagcggttctgaccatgaccatttcgctggacggagatgggacaacaacctatatgattaccattgcagcgatgctgcctctctacaaacggctcggcatgaaccgtttggtgttagcgggaatagcgatgctcggttcgggggttatgaatattatcccgtggggcgggccgactgcgagggttttggcttccttaaaattggacacgtcagaggtcttcacgccgctgattcccgctatgatcgccggcattctctgggtgatcgccgttgcttatatcctcggaaagaaagagcggaagcggctcggcgtcatttcgattgatcacgcaccgtcttccgatccggaggccgcaccgctcaagcgccccgctcttcaatggtttaacctgctgctgactgtcgctctgatggccgcactgatcaccagcctgctgccgctccctgttctttttatgactgcgttcgccgtcgccttgatggtcaactatccaaatgtcaaagagcagcagaaacgaatctcggcgcatgcgggtaatgcgttaaacgttgtctcaatggtgtttgctgcgggcatattcacaggcattctctccggcacaaaaatggtcgatgccatggcgcattctctcgtttcactcatccctgatgccatgggcccgcacctgccgttgatcactgcgatcgtcagcatgccattcacctttttcatgtcgaatgacgccttttacttcggtgtccttcccattatcgccgaagccgcttccgcttacggaatagacgccgctgaaatcggaagggcctccttgctgggtcagcctgtgcacctgctcagcccgcttgtgccttccacctatctattggtaggaatggcaggcgtcagctttggcgaccatcaaaaattcactattaaatgggccgtaggaacaacgattgtgatgaccattgcggcgcttttgattgggattatttctttctaaatgtatgagcttgatcgtagcattgagtacagaggggagaagatcaaataggatattatgagtgaatagaagattcatgccaacaactcctcattacaatcataagagcctgctatattgcagcaggctctttcacatttggcattatttttttgtatagcgcacccagtcataatgagcgtatagcggatttacaccattgtaggaaccgagccagtcatcgacacccgtgccattccacaagttcatcatgatctttccaggtgttatcggaatttggtttgttgcagtatgttttaattgcccatcgacataccatttaatagagtttggctgccaatcgaatgcatacgtatgataggcattggctgcatcaaacccgagatcaacaatcttctcatggtttcctgcaccatttgtataatagttaaattgaacctttgttgtatcttttcctaaaaattcgatatcaatctcatcccaaggagttccatctgttggacctgtgtaagtgaagaacgatgaaacgatccctgtgtttttagctggtttcattctgacttcataaagtccatagccatatgtttgaacagaacggttttccccgcagtcaaacttgttataagatgggcttgttagcgctaaacgcatttcacccaatgacgtcactgatacgttattagcccgccacgtgcagttgaacatatttccattcgaataaccatctgctttttgccaaaaaccggagttatagccgttaaaagggtcaaaaaacgatccacctgtttgagctgaggcagtagaagtgactgcaaacaaactcataaacaatccagtgacaagaagcagcaacactcgtttcagataaggcatattggcattcccctttcattgaaagcgttttctatgttgatcttacatgattcttttaaaagggaacatcggtcaaaataatgataatatcgaatcttactgacttgaatcctgtaactatcatcatctttcctctgaaaaaaataaaaacctaaattaccatcagcacagacagagatgatccgcactcattgtaatttaggttttgcctgctttatcagtaacaatcctaccattttcatatgtgaatgtaagaaaaagtgaacacaaggaaacaaaaatgtcagcgctctcattatgcatgtttaactaccctttctatgtgaatggttaaatacagcagctcgtcacttgtgagcttgtgctcatactcccgctcaatgtaggtttggattttcttcgtgcattcatacgcgcgatgatacttttctttcactgtatccagcaaaaaatcgtcctggctttccatgtgagtgccgttaaatagacgctgcgcgaaaaactttaagtgggtgacaaaccgataatagtgaagcgattcttcgttgaattcaatcttaaaatggtattttacaatactcaaaatctcttgcatgacttttgtaatgttgataatattgggcatctcttcattcagctcggcatttacaatatgcagagcaataaagcctgcttcatcctctggcagagacacaccagtcttgttttttaccataaccaacgcttctttgccgatcgcaaattcgtctttgtacagccgttttgtttcccacagcaaggcgtttttgatatcaagccctttctggttgcgctggatggcaaagttaatatggtcggtcagcgacacatagatgctgtcgttgagctttttgccgagctgtaattttgcgtagctgataatctcttcggatacttccatacactcgatcggtatatcatacaaaagggttttgaacttttctgatacatccttgttatcgagcgtgaacactttctcaatgcgggcttcatcgacatcatcgccggactttttctgaaacgcgagccccctgcccatgactaccaattctttcccctgttcattgaccacgctgatcacattattgttgatcaccttcgcaattttcatggcatgtccctccaaatctactaagaacagactatatcttgattgtacattctttttgtactaggtcaatatcatcagagaaagacggaagctggtcagtacaattcactccgtacctgctgcccgggctgtttttgaagcagcgcctccagatggcgttcaaatgatgccttgtcagctttctgctttttgacaatgctgttcatgattttgacgctttcggcgctgtattgtgtatattgttttttcagctgatccagctgctgtcttgtcttcttcgcgtttttcggtgtgacttggccgatgagtttgatcatactgtctgcggtctcaaaaaaagcggctctattttctgtcagctgctgaatttcgatgcggctcatgtcttgattacgcgttttttgtagcaaggcaaccgcctcgctgttttgttttttgagcgatttgttctcaagcttaatcgattcgagattctccttcgcaatgtctgcttcttcttcagtcatgctgattcgcacgaagtattctggattgccgattccataatcaaatgcttcgctcacttgtatcatggaactgaacacaatggccagctgcctgtcgcttgcgagggcttggaaatcctgctttttcttactgctcatcggtttggctgcggtttgttttactgtcttttgatcacagtctgcgaacatctgagcctcaccttcactttcgcatgcgctcatcacaagaactgtgaccagcaggcttatacacaagcctattcgcctcatgctctgtctcctctctgctgaatcccttctggaaaataccataaaatatagttaaatggtaccagatgcacctaaccccagcaataaatcaaaagtatgatttgaagcgaaaaaacataaatattttgtaaaaattgacgtgcattccattcttttcaggcccatttctcgtacaatagaagtatcgttaccggagaggggctctgatgatgaaacgttttacgaaacaagaaaacagctgggtgttatatgactgggcaaattcagcttactcaattgtcgtgaccaccgcggtatttccgttattttacaaatcagcagctgcggaaagcggtgtcagcgccgctcaatcgactgcctatctgggctataccattgcgatttcaacgtttattcttgcgatgctcggccctattttaggcacaatcgccgactatgaagggtgcaagaaaaagttcttcggtttctttgtgtcagccggtgtcgccagcaccgcgatgctcgcctttatccctagtgaacattggctgctattgctgctgttttatacggtatcggctatcggtttttccggcgccaatgtgttttatgatgcctttctcgtggacgtcacgcctgagaagcggatgaatctcgtctcggcacggggttttggcttaggatacattggaagcacgattccatttatcatcagtattgctgtcatcctgctcgcacaagcagagactattccagtgtctgtatcggccgcaagccagctgtccttcttcataacggctgcctggtgggggctgttcaccatcccaatgattaaacatgtccatcaacgctattacatcaaaaaagaacctcatattgtcatcaacagctttaagcggctcggccaaacgatgaaacggatcaggcaataccgggcacttttcctcttcttgctcgcttatttcttttatatcgacggagtcggcacgattattacgatgtcgacatcctatggatcagatttagggatcggctcctcaagccttctgatcatcctatttgtcacccaggtagtcgccgcgccgttttcgattatatacggaaaactggcagaacgcttcacggggaagaccatgctgtacgtcgggatcgtcatttatatgatcgtctgcgtgtatgcctattttatggagacaacgcttgatttctggatactggctatgcttgtcgccacctcgcaaggcggtattcaagccctaagccgttcctatttcgccaagcttgtgccaaagcgccacgccaatgaattctttggcttctacaacatttttggaaaattcgcctcaattatggggccgctgctcattgccgttaccgcccagctgaccggtaaatcctcgactgcggtgttcagcctgatcattttgtttgtgattggtattgtgattcttgcctttgttcccgaggaaaccagcacagatgtcagccagcagcaaaatgacctgcccctttaactgggagcaggtcattcatcatttattcgctttattcaccttcagctgtttccctttgacggttgtgttcttcatcactttgagaacatgagggcctttaccatttaaaatctcaacgtatgaggcgttatccatgatcgtgatgatgccgatgtcgtcagctgacacaccgtcaattttggcaatcgttcctacaaaatcaacggctctgattttctttttctttccgccgttaaaatacagcttcataatgtctttattcaactcttcgcttttgtcctttttgctttccggacggtcattcagtttagctagaaattctggtttcttccttgccacttcctcttgagaaggggcttctattttttggatttcaaatccgatatattcttcaatgtcggctaaaaaccgtttttcgaaggccgtgacaaacgaaatggcctttcctttgttccctgcgcgtcccgttcggcccgtgcggtggacatagctttctttttcaagcggcagatcatagttgatgacaagggagatattttcaatatcaatcccgcgcgcggcgacatccgttgccactaagtaacggtactcgccacgtttaaattcattcatgacgtcgaagcggtcttcctgaatcattccgccgtgaattttatcgcatggatatcctaagtcatccaattcatcggtcagctgattgacgtgctccttcgttcggcagaaaatgatgcagctgtcgggattctccgtcatcagcacatctttcagcaatgaaaacttattctcttctcttacttgaatcaccgcatgttcaatatttcttgtggttaggccggccgctttgacttcgatatgctcggggttttgcatatattgacggctcagcttctcgatatcctgcggaagcgtcgccgaaaacagcatcgtcgtgcgctcagtcggcagatgcttgataatcgcctccacctgctcaatgaagcccatattcagcatctcatccgcttcatcaatgaccaaataagagagacgatccaacggcagcgtgcctttttcgatatgatccagaacacgtcccggcgtgccgacaacaatgtggcttttttgcttaagctcagctttttgtttatcaaaggaggattttccaaatacggctgtcgctttgattcgtttaaatcgtccgatgttcgtgatatcttcctttacttgcaccgcgagctcacgggttggagttaaaataagcgcctgcggcttgttttcatcccaatccgccagctcacagagaggaatcccgaacgaagccgttttcccgcttcccgtctgtgatttgacgacaagatcctttcgttcaagggcagcggggatcacactctgctgcaccttggtcggttctgtatatcccagtccttccaatgctcgtaaaatgtcatgactgatttgatagtttttaaaatgactcatgtataaactcctgtctcttgcagatgttctcattatactctaattgaccaaggcatatgtgttttgtcgaaaaatgatgtattaaaagccagcgattccctggcgttttagctcctgaacagccaatcgcgccagtgcgtcggcccccgcgcgattcgggtgcagcgtatctccatccatataaagcccgagtgttctttccggaccgatcgatgtaaagtatgccgagctgaggacatttaagtcaatgagatatgttttttcctcttcggccaaagctaaaatagaggccctgtaccatctgtttacagacgaatggatgccttcagaagtaaaatcggttgcccggccctgaggcgttgataggatgacgtccgctcctttcgcttttacctgacgaatcatatcacgcatcatctctttaaattccgcttcagattcattatgcttcggatttgtgtcattaatgccaagctgcaagataaaataatcccccggcttgatgtacttcaggatcgcctcaagctgtccatcatttctgaaccctctcgcgatctgcccgccagacgccatgtttctcacttgaaaggtatgtttatcgatatagtgaggcagcatctgccccagcccgcctgcttgctgctgttgagcggataataattgcacaccgtcgagtcgccgccgacataaatggttcggttcgtcaccggctgatcagacaatttctttattttcaaagcgctaagcgtaaaagcggtgccagctttccctctgtcaccagcagattcagctgcccgtcggtgacaggaatttggaacgtatcctccgcgccatcccctgtcatattaataacctgaaacacgccctccgccgccacactggcccttgccgtattgccaagcgtcgccttcacctcataaaggccattcgggagatccacattaaacgtgttattgcttttcgtcccatacgctaaaaactgaaccgcatcactcttcacaccagtcccggatgccgctacatccctcatattctccggtgtttgaaaaccgtagccctttgaccggtcataccgatcagacgccctgacaccaatataatcaggctccaccgaaccgcttccaaagtcaaattgatacaccttcggctccgccgccttcactttctcaatcccgccaaaacacatcatcaacatcatcacaaaaaccgttgccatccattttttcatcaagactccccctctatgaaaacgcatacattaatgcatactcggtgattgtttctttatgatgactgaaggaagaaaaaaattgcgttgaggaataaaaatgaggggagagtctcaagaaggggaaaatcagtgtgacttcttgtcacacttgatcacatcccaacctccgcaatagaagcttatttggttttcttcgtcatacacataataacggagtctttcccattgatcgtcagtcggtacaatctccaatgcaaccgaatcgatggattcaagatcatccagctttgatgcactaacgtcttcaaaccgtaaatgaatgtcacaggtttgagctgatagttttaattcaaacacaggaatatgtatataacgatcatcttctttcatatagaaagaaaactcgtttaatgtaaatggacctgtatcctcatcagaaagatgctttttcaatttctcgtattgtgtgatattcaaatggattccccctatttttagttaccgccaaccatatagatgtctacagcatcgtattcaaaccacatgatccgttcacctgagtccgtcaggcattggagtttgccttcggaaaaatagcttttatccggttgaggatcagtgatcagaaaaacatcatcattgatggaagctaacagaaagagaagtcttgcaatgtcccaatctgctctctgtaatatggattggaaatggagttctcttttcgctagttttatcaccttgtaagcataaccttcaaagtactcggacaggtcttctataaatgaaccagtcgttattacctgtatcatgattcgatcgtaggcaagccctgcccaaaaacgataaaacgactctgcatcttcaagttcgcatgacataacggtttggtcagacttaagcttgatcatgtccaaattgccaatactgcttatagaggttatttccataaaatcttccccttatcagttggatagcgcaacgcaaatctcttgtctgacttgttcatacaagagaatgtgatgatacagatctttatcgtttttgatcatatccggaagtatgtcaggatacagctcaaaaaagcttttctccaacgaacgccgctgatgcccggacatccttttattcgccagcacataatccaaactgccatcaactagcataaaaaactcatagatttccgcttcaaagccgtacaattcatcaggatacggcgtttcttcaagctctcgctgtctttttctcagcttttgaagcacgttgatcctctcctcaccctattcaacttccatcacctcatattgccggcaataaaagcggaatgtctgctcttcccattcttccacaaggtacgtgccttgtggttgcatttcaatatggagaagtccatctgatagattcgatagggtttcgatttctcgtatcgtaacgactgaaacgtctttgaatatgacaacaatcgtacgtgaatgataaacagctgctaactcaatcgtataaatggcaccaagcacgtgatctgtttctcgataaaaacgccatttcttgatatgctgaaacaaaataggagtagctcctgaaatactcaattttgattcctccgttaatagcgtctctatactccatactcacagtaaggcttcaagtcaggaaaagaatccttcaacattctttctatgttttcatcggtcactgtaaatataatatctgttgaatcaaagaaaccgacttcgaaaatacattctttcacaggggagatataatcatcttcataaaagtcagcattcccatcaacaaacggaacttgtgttatatcatacagtatcgtctctttaggcacagcagttaaaatagaaaatatcacataaatctcatattcatttaatatacgatgaaattcctcacctgtgataaaaagatagtcttcacgctcgccaatgatatcgttccaatgatccttatccgaggatacatccatcatatttaaaatatcgccaatgacccaatgatactcagtgatacgtagggggaattgtttgaaaaaatcatttaagagaaaaagttcagaatttgcacattccagacaatacctgctcatatgtgcctcaacctccccctaataaaagcccttcttacaactcatacttaatcaattcctccatcgaggttcccttgaaatattgataaagaatatcctcaatactaaggtgaccaaatagcccaatcgggttgctaaaggtcttccccgttttttatcaacctctattaaatcactctctgccgctaatgaatcgtcttggctaatgaggtattttccatcttcatacatgacaaatgttatagtagaatgatcaaattttttcatcaaatctatcggcaccttggaaacaaccttccaattcccctgaagaaagcctgtatatcctgtattcgcaataaaaagggttctttgcttttctgccatcatgagagaaatgtcttttttactcaagcgttgatctgtaaaaatatcaaaatactgaatgagaagatcatcatttttatctgttgctaaatctccttttaccactaatgcatatgtgaactgattgattttccgtaaagggatttcaatgacaacaccaggcctaacttcacttaaagtagttctttttttcatctttaggttgatgtcagtgacttgttttccttctaattctttaaaaagcgaatcgccgtctgagtttaatacctgaaagagggtataaacaaattcatttagagtaggcttacgatccaattgttcaaggaacacagcgtgaaaatcttcgatggcgtcgtgacaaatatccaaaccatcatcacttacgaatatctttttatttttatatttctcttcccaaaagcccatgtttcacctccgtttttcagaacactcatctattttgaaacaggataggcggatcatgatctatcgcctccaacagctcttcaccaaacacagtgattgtcaatttccacgggtctcccaaaagtccccaggagaagtcctgatgaaaaaagaaataatagtctccatttggaaatacgggaacaggccattcgccaaattcatcctgaggcattgtctgatgagggctaaaaatatatccgtcatgctgccagtctaatgcgtacatcacatcgtgttttccagtacatgattgaaatgcttttaaaatcgaagtctctaaatcattcagcactctgaccacttcatcattactggctttaccgctcatcccgcttgaaatatcaaacacttgatatggatcaggcggaatgatgtgatggcatctgcttccgggtttccattttatgatcttgttcacttctgaccagatgcggtcttgttttgtctgacttaaagcgcgccaattcatcataatctcatccctacaccttattggatatcctgcttataaacaccagaagagaccactgcgtaaacagcgttactcgtcagtttcagctgttgaacgtctagggcttcaccgttcgagtcacagcatgttatctcttccatctcttgactcacatcggcagaaatcaaataaagagacgactcaagctcttcactgtaacaattgaacgtcccaaccaaaaaaccttcttcagatatcgcaagctgataaaatgcttctgagttcggctctttatccgacagaatccatacccgtctcacgaccgtgtcgtcaaacgcggcaatgactgcatctccgtaatacagcatataaatcaagccgtttttttctgcaagtccataacaatcatctacagccggcgcatccatttcttcgagctttctatcaatgtgtatttccttctgctgaccatctaacgtaaaacaccacacactatggccgttgggattttcatcatcataaatgccttcatcatttaaaccgacccaaaggttttgtttctcatccaaaagacagcaggaaacccctgaaggcaagtgaaaagctcttttcacccttccctcttctgaaaaaacctttaccttcggctcgtacgattcgtaataaacgaagacatagccatctgcacattgttgaaagagcaggatatcactgtatgaaatctgctctttcactttaaaaacccgaatatcaccggaaggatcatagattgagatggccacatcacctttcacaccttttccaatgtagacacgccccagtggatcagcatggaaaaaacaatcttgggtgtccatgttgataattttattcatttttaattttttcatttgttatgctcccagtttagaaatgaagtgataattaagcatttattagctattagtaacggacagcctagtttcattaatcgttttgatataaagctactttccaattcagtcttaaatcatttagtgtttaattggtatgcataaaacgattgatcatcaaagcgaactgtttcagcttctatagcaatcagcattctgttcatgtcaataagaaagttagcatttgattgatactccggaattatagaatttgatagattcccgattccttctggatgataactcatctcaaatacttgccaattgtattcttccggatctattttttccaatctcatgtcgccaacatctgcactataataagcggatgccatattttgaaataatattttatgggtatactcagcttcactttcaaaaacctttatattaagtgagagctcttttttaaacacattaaaatctaaataaaggacactgcacccctcatcaatgtaatcaacccattcactaattgttttgtacattgtcatctcctgcctcttttttaatcaataacaccttaccaccaaacacaaattactccatatattgtttgatccaatcattcaaatcatctgttgaatgtaaataagtttcaggagaatctttcaaatcaatcccacttagaaggattaacatatcccagcctctatcgtcttctacttcggggtcatccgtataaacataagtgcccgcccaatctgacacttcttctcttgttgtttgtccatttaagacacttttgattttatttatgcattctagtagttttggctcggtcaaattgatcaccacgcactcaatcttcgtttggtataccgataattctatttattttattaaagcctgctaagcaatcagatgatcaacagacaattcggtaaagatcctctaccgaatgaattctattattcgctttgaagatccaaacaaattattaaataattgttaaatgatatttagaatattttctctgtttattgtccctattctgatagtctcggagtctattatttctatttggcagaagaccccattcagtaaatctttaacaagtgttttttctgttaaatgaactctgctcaatatatcctttaacttaacgtctttttagtaaaatgatattctcatgagcaacatttgcatttttagattcttgcagagtatatataatcattactatcgctttttaataccaacctaagttttcaatatattatacgctctattgttttatattttttttaagctaatcatagtcaataagagttgatatttcatcaaaatagtacattcacttttccttttactaattgagaaagccttttttccgcaccaataatttgaaataactgtattattgatttaacatgttagcttcattggaataggattacaatatttttctagaatgtttatgttattttaagaatcaaaaaaggccgcataggcctttttactttttccattattgcatttgttcaatatccgtaccctcagctgtcacattcgccttcccctgcctcctgacaagcgtcaaggccatacccgcaaagatcagcatgatgccaagcgtttgatagaggtcagggcggaagcctgtgaagacggtatcgagcacgatcgcgacagcggggtcgagaaatacaatgattgaaataaatttcgtcgataaaaatcgcaaactgtcaaaaaacaacaaatatacaatacccgtatggatgatgccggtagataccaccataatccagtttccctgagataggtcagcaaaagcaccaaagtgaataaatggaatcaggatgataacccctaaacccgtctgcaagaaggtggtcgtgtaaggactgagattgtgaatgccttttcccaataaagtggtgaacgcataaaacagtgcggcgagaactgcccatatgatccctgatcccatcagctgtgtcaatgaagtgctgccgttaatcccggaaatcagcgcagttcccagaaagcagatgataatggagctgacggagatcacatttaatttctctctgtagaagaagctccccagaagaagaacaagcaccggcgctagatgataaacggagatggcaattgtaacggacgtttcttcaaaagacttaaataaaaacacccagttgaatacaagaaagaaaccgcacgccaatgtttgcagcacgtctctcttgctccatttttcagttttatactggccggacgccagccagcaaagacctaaaaacagcgtcgcgcaaaggcagcggacaaagactaattcaaatgacggcagattggtatgctctgagaaaaagccgatggagccgaaaatcaccatagagatgaccattttgattacggctgttgatttttgttttgacgatatggaaagatcctgttgcatcaaacgtattctacctccagtactgcatagcataaactgttttttatgaattcagaaatctacacataaaattcctcttttttacatgtagatattataacacttctattctaaataaaaaaaagcgcccaagggcgctttttttacaaatctatcgaacaatcaaaaccgggcatgttgataattgagacactttatggctgacgcttccaagcatcatttctttcaggccgctgatcccccggctgccaactacaatcaggctgacgcctttctcttttgcgtgatttagtatctcatgcgccggctcgccattcgcgtaaatggtttcagcttgaacgcctttttcggctgctttttcttttgcattttcaaggattttcaggccctcttttttaacctcgttcctgatttcatcaataaagtgttcaggcacatagacaattcccgtcagagaagaagtcgtgacgacggcttctctccccacatgaagaatgcttagttccgcttgctgctcttttgccaaatgcactgcggcatcaagcgcttttgcactcatgtctgatccgtcaatcgctactaacattttgttaaacatgctcttcccgcctttcggactgtgggtggttcatctttctcttttattgtccgtctgcatttcgttattgtcaattgaagcgcatgagttttcaaaaatttgtcagagactctctccgtttgtggcgataacctgctgataccagttgaagctttttttcttgatgcggttaaatgttccatttccttcattgtccctgtccacataaatgaaaccgtagcgttttttcatttccgcagtagatgcactgacaaggtcaattggcccccatgatgtgtatccgattaattcaacgccgtccgcaatggcttcgcgcgcttcaaataaatgatcacgcagatagttgattctgtaatcgtcctgaatcgtgccgtcctcttcaaccttgtctacagcgccaaggccgttttcaacgatgaacagcggcttctgataacggtcgtataaggtgttgagcgtgatgcgcaagccttttggatcaatttgccagccccattctgatgatttgaggtaagggtttttgactccgcccagcaggttgccccctgattttgcaagctcttccggatctgtgcttgccgccatcgacatgtagtagctgaatccaatataatccacagtatgttctttcatgagctcttcatcgccttcagccatttcaatttcaatattgttttctgccagatagcgtttcatatatcccgggtatgcgcctcttgcctgaacatctgagaagaaaagtgttttgcgctcattctccattgccgcgaagacatcctccggcttagaagtcatcggataggttgtcgttgccgctatcatacagccgattttcgaatcaggaatgatgtcgtgacccgctttgacagcaagagcactggccacaaattggtggtgtgccgcctggtacatcgcgtttaatttgttttctccttcttcaaaaacaagaccgcctccggtaaatggcgcatggagcactacgttaatttcattaaacgtcatccaatacttcactttgtgttgatagcgtttgaaaaccgttttggcatagcgttcataaaactctatgactttgcgattcttccagccgccataatttttcactaaaccgagcggcatctcataatgagagatggttacgacaggctcaatatgatgctttaacagctcatcaaacagatcatcataaaatctgagaccgtcttcattgggctcctcttcatcgccattcggaaaaattctcgtccacgcaatcgatgtgcggaacgccttaaatcccatttctgcaaataaggcgatatcctctttataacgatgataaaagtcaatcccgttgtgatacagattcaaggaagtcattgattcatcaaatggagacatgatcccgttcggcgatacgtcagctgtcgaaagccccttaccaccctcgttataagcaccctccacttggttggcagcaactgcgccgccccataaaaatccttctggaaatcgttttgcatttgaactcatattgatcaccccatcagttttttaagataaagcaagcagcgcttcttttggctgcactttaccgatctctttcaccggcgaaaacgaatattggtctgtgttggtcacaatcaccggggtaataacgtcatatcccgcggctttgatttgctccagatcaaaggacacgagcggatctcccggtgcgaccttgtcgccttctttgacgtgagccgtgaaccattgtccctccagctttaccgtgtccaatccaatgtgtatgagtatttcagctccctgatcactcgtaatgccaattgcgtgttttgttttaaaaacggtggtaacgcttccacgaacaggcgacacaacttctccttcttcaggctcaatggcaaatccttttccatgatcccggcagaaaacactccatctttgacttcacttaaggctttcacttctcccttaatcgggctgtgaatgatctctctgctgccctcatgcactgccggctgctggctgccgtcagaaggcacatcctcgaatccaagcaaatacgcagctgctgttcccgccgcaaacgcaatcacaaggccgatcatcgcgtaaataaacgttgggccgataaagacagggatgctcgggagacctgcattcccccgacgatataggaagcaacacccgtcatgccgtaaaacgcgccaccggctgcaccgccaatcaaagcggccgcaaacggctttttcaatcgcatattcacgccgtacatcgcaggttctgtaatccccatcagcgccgtgatgcttgtggtaagcgcaagtgatttaaattttttgtttctggagcgaaggaagacggcaaatgatgctcccgcctgccccatattcgccaaaaacatagccggcagtaaataatcgtgaccgttttgagcgatattgttgatcatgatcggcacaaaggcatagtgcatgcccgtcataatgattaaagagaatgtacccgccagcaaaatcattgccacaagccctgcatgatcaaacaaataattgaccccagaagacaagtattctcctaaaatagcgccaagcggaccgactgtaatcaatgtcagcggcacgacaatcaatagcgtgaatgtcggaaccacaatcaatttgagagatgcgtgtgtaaaacggtcaatccatttttccacgtatgaagcaatccaaatcgccagcaaaatcgggatgaccgttgacgaataagtggcagcggttacaggaagcccgataaaggaaatcggtttccccgcaccgagcagggctgtcaaatccggatgcaggatcgccgccgcaatggcagccgctacgtacggattgcttccgaattttctcgccgcactcatcgctagcaggagcggcaggaagtagaacgcgccgtcaccgacagccgttaaaatgacatgaacctggctcttctccgccatccagccaaacgtaactgccagcgcaacaagccctttgatcatccccgctcccgcaatcgcaggcaaaatcggggtaaacacaccagaaatcacatcaaagaccgcactcagcacattctttttctgagaggatgaaccagcgctcttttcatcactgagattgctgtgccgcacaatcgcctgatacaccttcggcacatcgtttccgataatgatttgaaactgctcgccgctgatattggtgcccatcacccccggcagctgctccagctgactgcgatccgccttcgcgttgtcatgaagattaaaacgcagcctcgtcatgcagtggatcacgcgctgaacgttgtcttcaccgcctacgagttgtaatatgtccttcgataatttatcataatccatgtgtatacctcctttttatggggggactgctggatgaaaggtggccgcctttcaccagctttttttctatcaaatgctgcatcacctcctaaaagagaataaaaaaaacctaaatgacacagattgcgagagtctcctcctgcacctgcaccatttaggttttgcctgctttcgcagtaacaatcctgacgggtcgctgtatttgtttgtaggtatactttagcactagatttgcgtgatgtcaacgctttcatttttggtgttgactaaggtgattgctcaataaggactattttttataacggtaagccattttgtatattttgttttatttttccgaaaatactatcaaatatatcagctgacttaatataaaagtaaaaaaccttgaaaggcattagcccatcaaggtatatgttttatttttgactatcccttttccatatactttctccgtcagttaaaaaaactgcacttggcggatcatcataaagtgaaatttcaactaatgaacctttcttttgtattaaccaattatataaactactttcttcactagtaggatgagctaaaatatcatttacttgaaatgtaactgcataatattcgataaaattcacatcatcgtcatccaacccattgtctgtttcaaagagtgtgtctggttcaccaataatctttaatccactatcccactctattatcaagtcactatctttatactcttttaacgcttttattaaaggatcatattccatgtatatcctcctcttattacttctttaatggttctgaaggcactatatgcgctccgtcttttccgtaatgaatcattcctctagtagtttcaatgtattcaccagtatcacgatcatagtattttccaattggtttaccaaagtctactctttcttttttaccgtttggtagtagttgaccttttcctgcaaacttatcaagcaattcctgtgctgttttattatcaccatagaaaatactcttgtttttaccatttgctatttcttgtttgtaatttggcgtattaggaatatgtttctcttgagcacctggctttactttaactgggaatccatgtacttctctgtaaggtcctttaggtactgacttctttccataagaaggtacaccattacccgtatccttagcaacgtttttaacttccgcagccttcttagcctttttcccatcattaataagtttattaatatctattaacttttctaacttagctattttggcaaatggtactgagtttatggaggcaacaacacggtcttttcctgtgactttttcgcctgataccggatctctgcccgtggctgccttaaaaagatcatacacgccggtaagttctacagctgtctctaaaattttcacatatccattctcatccactttaatgtccgaaagcgagacgacaggttcaagcttcatgtcattaccagatatgtatacattgtaaagtgtatcattataaacgacttgcttaacctctgcatttgagaaatcagtttttatatgttctctatgttcactcgtattatacactttaccattgataacgatgatatttttacttacctttttagaatcacccgttttgacaactgaatccactttagacttttcattctcggctaatttcttcaacatcatctccatcggagaatcatccgcctgcttcatttgcgggttaatcgcgccgaaggtttggttgatgttttcttcttcctgtgatttcaggatggagccgcttttgtagcctgtgatttcaattttcgggccggtgtacatcgtttcgagctggtctatatattttttcatcgtttgaaaatctgattttgcggtttctagtgcttgagtttgatggccgtcaaattgaaagagcttattcagggtgtctgaaatcagtcgctcagcctgttctgtctccattcggaaaaaggtatcattgactgtcggcaggctgacgatgtgatctatggctgatgtctggcgattgactgcgtcagtgagctgctctgtcacttctcgtgcatgcttgaccccatgtctcgcatcgtgtgagagaaaagcctctgcgatcatgccgtgggagtcagattctacagaggaaatcgcatgctgtgtttgtttcagcacttttttgtattcgtcgataaacatgccaaagaaaaggagaaaaggcttgtggcactcctcgtaaaaggtccggatggcatctccgccttttcctttcagcgcgtccttcatgcctgccagatgctcaacgcttttttccagcttctccagctgttgtttttgcttgtccagtttctcaatcgtatgctgaatgccctcgtgaagagcgtggacatctaatgttttcaatcccttgtcctcccgcgctttatttcatggaagatgatatgttttcgtccgtttccttcatggcgtttatcgcgctttccgtttgtgcgatatgcttggccagaacagacgcatatgcttcagtgagctctttgatgtccttatttaattgctcgatggacttcacaacattcaaatggtttctgcctgagagatggccgggcaaggaggacttgagtgcagctgaattcttgagctgagaaagccctttcttcactgtgccatacaccattttaatttcctgtgccatttgtgctcacctcactttttatgtttttccttctctatttcatgctctatcctcgtaatttggcgtcttatggaatagacatcgccctctaatgagtggatttttccttctatgctttcgatgattccgctgacttgatcgcttttgatttgctgatatgctttgttcattccttcacgaatatcttcaaaccgctgagcatgtattcctctccatgcctcccggttaagatgaggccggtgaatgagatgctgggcctcggagaattcgtgtttgatttgcctgatttcgtgcagcactcgttttaattgatggatctgttcctgcttttcatgtaagtcggcttttaccgaatgtaacaacatttcactatgcatgccgcaacacctcgtgtttctatcaaactgtgtcaattctttacaatacagactattttcatattacgtgatgggtcatattggataaataggtaaaaaggattgtcttgaggaactttatcccggttctaaatagctaaaaattcaatttcataactttgtaagagggagaatcatcatgatggggacttttcgtttaggtcttgaaccacgctatcacttctgttttttctctcgctcaaccatttcttatagtcaataaagctcataaaaaagcgccttctctagaaggcgccttctccatcttatttagatccccatacagcctcaccgctgccattcaacacactaaacgtcatgacgttcttctctctcatcgaatcccactggcgtaaaaataccccgttatacttcttgcctggtaacgtgatatcggcggtattttttccggttttcttccatgttccggtcatttccccggaaatggtgtggtttttgttgagctggatgttgatggtttgtttgatgtcggctgagatgtcttttccgtgctggataagtttgtatgttcctgtgatgtctttttgttttacttctttcaatgtttcgcccgcataacgatatggcgctgctaccggccagccgtctttgttcatgaacaattggtggactctgacttcgtgttcttcacccctgcccgggaagcgggtgtggaagattaaataggaacgcccggttttttcgtcataatatgcggagttgtggcctggtgagacgtacccggtgcctttttcattttctgtttcaaaagtgtaactgcccatgagtttgacgccgtatggttcgatggaacggtcgtcgaagaatgtgccttctttgccgcggacatcaagcattggattgccttctgcatcataataagggccgtctggtttcttggagcgggccacacggatgttatagccgcctgttgcatcaagaccgccatatgataggtataagtagtagtattgggtgtctggattgtagagaacatacgggccttcgattctgctatggttgccgccaagcagttttttcccgtatccctgtccaggaagcgggaagcccgttttcggattcatttcaagtatgaaaatgccgcctgagtatgatccatacaccatccacagcttgccgtctttatcaaagaaggtatgcgggtcgacgacattcggatgttttgttgcgtcatacggtgttccatcgttgcttgtgccttccattcctgatttcaaaaagatgcctttgtttttgtatggcccttcgatgttgtcagcgacggcaacacccatggcggatcttggtgagtcgccgcggcaggcgttgtagtacatgtagtatttgccgtccgccagctgcgtgacgtcagccgcccaaagagtatccgattgggcccattcgaaggtttcttttaattcttcatagacattcggaataagtgggttgtcattgcttacgctgttggtcagctgctgccattgcataaggtcatttgtttttgctgaagcgagatgagatccaaaaacataaaaggtgccgtttgtttcaatgatggaagggtcatggacgctgacttctttaaatacaggtttttgtgcatagacggagtttgggagggtgaaggtcatgataagagctgcaagaaaacatacacggaacaatcggttgaacatctaaacaattcgcctctcttttttattaaattttaaacgcttacatttccctatgaagataccccggcctattaaaacagccgaatgttttcatattcaaacagataggtgatttctcactgttctcttacatagtcagactgatgtctgtctgttttgcgcagaactgctgcttgcatatcctctccttcatagttcaactcttttgctgtttctccttctttcatcactctgtttttcattcgcgtacatgtaataactgctttgtcaggttttgcatcgactgtgatacagtcatttcgttgtcggcgttttttaagatgatgcctgattgcccgtcaacaccggagtcattcggctggctctttataaaacgccttacgaaaaatgcgactttgtaaacgcatattgagagttagacagcggcgcttgcctccttgtctggatatcgtgtgcaatcgctgaaaaaacctgttctgctttctgcgtcgcgctattacaatagcaatctaacttgttaaagactgtaaaaaaccttttgacttctgctgctgaaccaattaatataatactcagttaatagttatcagaatttttaggaattgagtgattcatatgacactgcataaagagcgtcggatcggccggctgtctgttctcctgctgctgaatgaggcggaagagagtacgcaggttgaggagctggagcgagacggatggaaggtctgtcttggcaaggtaggatcaatggacgcgcataaagtagtagccgcaattgaaaccgcttccaaaaagagcggtgtcattcaatctgagggttatcgggagtcacatgcgctttatcatgcgacgatggaggctttgcatggcgtgaccagaggtgaaatgctgctgggatcgctgcttcggacggtgggcttgaggtttgccgttttgaggggaaatccttatgaaagtgaagcagaaggcgattggattgctgtctcgctttacggaacaatcggggcgccgattaaaggtcttgagcacgagacattcggtgttggaattaatcacatatgaaacagcccatagatcttagacgatagggggctatgcgtgaaaacagatgttcacagcatagctcctttttgtatgggcgctttaccaaagtaaagaaaaaggagttgggcttatggtgactttagacggttcttcattgacaacagccgacgtcgctcgtgtgctgtttgattttgaggaggcagcggcttccgaggaaagtatggagcgcgtgaaaaaaagcagagcggcagtggaacggattgtacgcgacgaaaagacaatctacggcatcaacaccggatttggcaaattcagcgatgtcctgattcagaaagaagactcggcggcgctgcagctgaatttaatcctttctcatgcctgcggagtcggcgacccttttcctgagtgtgtttccagggcaatgctgcttttgcgtgccaatgcgctgttaaaaggcttttccggtgtacgcgctgagctgatcgaacagttgcttgcttttttaaataaacgcgtccatcctgtcatcccccagcagggatcacttggcgcaagcggagatctggcgccgctttcccacctggcgcttgcgctgatcgggcaaggagaagtcttttttgaggggaaagaatgccggcaatgacaggcttgaaaaaagcaggtattcaaccggtaacgctgacatccaaggaagggcttgccttgattaacgggactcaggccatgactgcaatgggagtggtcgcctacattgaagctgagaaactagcctatcaaacagaacgcattgccagcttaacgattgaaggtttgcggggaattatcgatgcatttgacgaggatattcactcagcccgcggctatcaggagcagatcgatgtcgcagaacgaattcgcttttatctatctgacagcggcctgacaacctcccagggagaactgcgggttcaggatgcctattcattgcgctgtattccgcaagtacacggtgcgacttggcagacactaggctatgtcaaagaaaaattagagattgaaatgaacgcagctacagacaatccactcattttcaatgacggtgacaaagtgatttccggcggaaactttcacggacagccgatcgcctttgccatggattttctgaaaatcgcaatatcagagcttgcgaatatcgcagagcgcaggatcgaacgacttgtgaatccgcagctgaatgacctgccgccgttcctgagccctcatcccggtctgcaatccggtgcaatgatcatgcagtacgccgcggcctcactcgtttctgaaaataaaacactggcccatcctgcaagtgtggattccattccgtcatccgccaaccaagaggaccatgtcagcatgggaaccatcgccgctcggcatgcttatcaggtaattgcaaatacaaggagagtcattgcgatcgaagcgatttgcgcattgcaggcggttgaatacagaggcatagaacatgcagcgtcctatacgaaacaactttttcaagaaatgagaaaagtcgtgccgtccattcagcaggaccgtgtattttcctatgacattgaacgcttgactgactggctgaagaaagaatctttaatacctgatcatcagaataaagaactaagggggatgaacatatgactgatgtaaaaaaatcaatccgtgccaacagaggaacagagcttgaatgcttaggatgggagcaagaggcagtgcttcggatgcttcgaaacaaccttgatccagaagtcgccgagaagccggaggacctcatcgtatatggcgggatcggcaaagccgcacgggattgggacgcatttcacgccattgagcattccttgaaaacattaaaaaatgatgaaaccttgctcgtgcaatccggaaagcccgttggcatgttccgtacacacccgcaggctccgcgcgtgctcctagcaaattctgttcttgttccgaagtgggcagactgggagcatttccacgaacttgagaaaaaagggttaatgatgtacggacagatgacggctggcagctggatttacattggctcacaaggcatattgcaaggaacctatgaaaccttcgctgagctggcgcgacagcacttcggggcagcttaaaaggaacgttgacgctgacagcgggtctcggcggaatgggaggcgcccagccgctgtcagtcacgatgaatgaaggcgtcgtgattgccgtcgaggttgacgagaaacgcatcgacaagcggatcgaaacaaaatactgcgatcgaaaaacagcatcgattgaggaagccttagcttgggctgaagaggcaaagcgggcaggaaaacctttgtccattgcacttctcggaaacgcagctgaggtgcatcacacacttttgaaccgaggcgtcaaaattgatattgtgacagatcagacatctgcccatgaccctttaatcggttatgttcccgagggctattcccttgatgaagctgaccgtttgcgtcaagacactccagagctttacgtgcgccttgcgaagcaaagcatgaaaaaacatgtcgaagccatgctggcctttcagcaaaagggctctattgtatttgactacggcaacaatatccggcaagtcgcaaaggatgaagggctggagaatgccttcgattttccggggtttgtccctgcctacatccgccccttattctgtgaaggaaaagggccgttccgttgggcggcgctttccggagatccggcagatatttaccgtacggatgcgttattaaaagagctgttcccgacaaataaagcccttcaccgctggattgatatggcacaggaaaaagtcaccttccaaggcttgccgtcccgtatctgctggcttggatatggagaacgaaaaaagatgggcctcgccattaacgagctggttagaaccggggagctaaaagcgcctgtcgttattgggagagatcatttggactgcgggtctgtcgcctctccaaaccgggaaacagaagcgatgaaggacggaagtgacgctgtcggtgattgggctgtgctaaatgcgcttgtcaacacggcggcgggtgcaagctgggtttccttccaccatggcggcggcgtcggaatgggctattccctgcatgccggcatggttgcagtggccgatggaagtgagctggctgacgagcggctcgcgcgggtcttaacgagcgacccaggaatgggcattatccgtcatgcggatgcgggttatgaacgtgccgttgaagtagcgaaggaacaggacattatcgtgccgatgcaaaaataaaggagtgatgacatgccaaagcaaattgatacgattctcatcaacatcggtcagcttttgacgatggaaagcagcggcccgcgggcaggcaaaagcatgcaggatcttcatgtgatcgaagacgctgttgtcggcatccatgaacagaaaattgtgttcgccggacaaaaagggctgaagccggttacgaggcagacgaaatcattgactgttcgggacgccttgtaacgcctggcctcgttgatccgcacacccatcttgtatttggcggatctcgtgaaaaggagatgaaccttaagcttcagggcatttcatatttggatattctggcgcagggcggcgggattctgtctacagtcaaggataccagggcggcttcagaagaagagctgctgcaaaaagcccattttcatctgcaaagaatgctgtcctacggcacaaccacagcagaagtgaaaagcggctacggcttggaaaaagagacagagctcaaacaattgcgtgtcgcaaaaaaactgcatgaaagccagcctgttgaccttgtttccacatttatgggagcccatgcgattcctcccgaatatcaaaacgatccagatcaatttctggatcaaatgctttcccttttgccggaaatcaaagagctggagctcgccagcttcgctgatatctttacagaaacaggcgtttttacagtcagccaatcccgccgttatttacaaaaagcagctgaggcaggcttcggattaaaaatacacgcagatgaaatcgatccgcttggaggtgctgaattagcaggtgagctaaaggccgtctcagccgaccatttggtaggtgcatcggacgaaggcataaagaaattggctgaggcaggaacgatcgccgtcctcttgccgggcacgacattttatcttggcaaaagcacatacgccagggcaagagctatgattgatgaaggggtatgtatcagcttggcaacggattttaatcctggcagctcgccgactgaaaatatccagctgatcatgtcgattgccgcgcttcatctgaagatgactgcagaagaaatatggcacgcggtcacagtcaatgccgcatacgccatagggaaaggagaagaagccggtcagctcaaagtcggccgctcagctgatctagtcatttggcaagcctcgaactatatgtatattccgtatcactacggggtcaatcatgtacatcaagtcatgaaaaacggaacaattgttgtcaatagggagggagctattcttggataagtacccttttctcagagaagccgggtcttcgtttaaagaccgggatgtcacaaaaatgagcgacctgatcgcaacatgggacggccaagacattaagggaccggcgttgataggtgtccccctatcaaaatcatccatcagtcattcaggcgcttgctttgcacccggaacaatacgccagtctctgaaacattcatcagcctattctgctgagcttggagagcacgtcgtatcggagcttctatatgatctgggggatatcgatattcatgtcactgatatcgcaaagtcacatcatcacattttccaaaccatgcacgctttgctttcggaccatccggattgggtgccgctcattctcgggggagataactcgatcagctactccactataaaagcgatagcacaaacgaaaggaacagcagcagtgattcaatttgatgcccatcacgatgttcgcaatacggaggacgggggccgacaaacggcacccccttccgccgccttttggatgaagagatcattgaaggtcaacatttgatccagctgggtatcagagaattcagcaacagccaggcctatgaagcatatgcaaaaaaacatagcgtgaacattcacacgatggacatgatccgggaaacaggactaatcccaacgataaaagagattttgcctgttgttcaagataaaacagatttcatttttatatctgttgacatggatgtcttagaccagtcccatgcacccggctgtccagcgattggcccgggcggcctctatacagacgaattgcttgaagcagtcaagtacatcgcacaacagcccaatgttgccgggattgaaattgttgaagtcgatcctaccctcgattttcgagatatgacaagcagagctgcagctcatgttctgttacacgcattaaaaggaatgaaactctccccattcaagtgatcttctggcaggttgtattttgggtataagaaactcatctgcctaaggaatggcagctaaaaggagggcgagacagtgaatcttcaggagaacagcagccaacagctaaaacgcacaatgaaaagcaggcacctatttatgatctcattgggaggcgtcataggcacaggacttttcctcagtacgggctatacgctacatcaagccggacccggcagtacgatactcgcttatgtaatcggcgggttgatgatgtacctcgtcatgcaatgtctcggcgaattgtcggttgccatgccggtgaccggctcttttcaaaaatatgctacaacatttatcggtccatctaccggttttatggtcggcatcatgtactggatcaattgggtggtgacggtaggctctgagtttaccgcatccggtattctcatgcagcgctggtttcctgacagcagcgtatggatgtggagtgcgatttttgcagctctccttttcgtatgcaacgcattctcagtcaagttatttgcggaaaccgaattttggttttccagcgtgaagattgtcaccatcattttatttatcattttaggaggagccgccatgtttggcttgatctctttaaacgggacggctgatgctcctatgttgtcaaatttcacagatcatggaggattgtttccaaatggctttctcgccgtatttatcgcgatgatatctgtgagctttgccttttccggaacagaattaatcggagtcacagcaggtgaatcagcaaatcctcaaaaggatattccgcgatccatccgtaatgtcgcatggagaaccgtgatttttttcattggcgctgtgttcgtattatccgggttaatttcgtggaaggaagcaggagtcattgaaagcccgtttgtcgccgtatttgcggagatcggaatcccttacgccggtgatattatgaatttcgtaatattaacagccttgctgtccgtcgccaattcaggcttatatgcttcgacccgtatgatgtggtcgttagcaaatgaaaacatgatcagctcccgttttaagaaagtgacctctaaaggcattcctttaaatgccttaatgatcagtatggctgtatcttgtttatctctcgtttccagtatcgtggcccctggaactgtctatgtggtgatggtcgcaattgctggatttgcaggagtcgtggtctggatgagcattgccttgtcccagctcttgtttcgaaagagatttctgaaaaaagggggaatgtaaaagagctgacatttcgcacgccgctttatcctcttatgcctatagccgctctcttattatgttctgcttcttgtatcggtcttgcttttgatcccaatcaaagaatcgcacttttctgcggagttccttgtatcatcctttgctatctcatctaccatttcaaaagaaatgttacaaaagcgaaaaaaatcagccaagaggaatatccggccgatcacatcctataattaaaaagcacaccccgcccagcatgggatgtgctttattttttattctgtaattaacgtatgaatcagcttcggcgccttcgcttccgcggcgatgcggatgttgtcatagacttttgcaatgacttcatcaacgttttcgcggttggcgtaaagcgttacgagcggttcccctttttctactttgtcgccgacctttttgcggagcatgatgccgacggctaaatcgatttcgtcttcttttgtggcgcggccggcacctaacagcatcgccgcgacgccgatttcgtccgcaacgatttcagagacgacacccgcttctttggcaggcacatcaatttgatatgcggcttgcggaagcttagacggatcgtcaacaattgagctgtcgccgccttggtttttcaggaaatccttgaatttctcaagcgctttgccgtttttcatgacttcttccagcttcgctctcgcttcgtccaatgtatcggcttttttcgcaagcacaaccatctggctgccgagcgttaagacaagctcatgaagatcctcaggcccctcgcctttgagtgtgtcgatcgcttctttgacttcaagcgcatttccaatcgcaaagccgagtggctgggacatgtctgaaatgacagccattgtttgacggccgacgttatttccgatgcgtaccatcgctttggcaagttcagctgcgtcttcttctgttttcatgaaggcgcccgctcccgtttttacgtcaagcacgatggcgtccgccccggcagcgatttttttgctcataatcgagcttgcaatgagcggaatggaattgaccgttcccgttacatcacgaagcgcgtacagttttttatcagccggcgttaaattgccgctttggccgatgaccgcaaccttgtcgcggttcacaagtttaataaattcatccttcgtcagttccacgtggaagccatcgattgcctctaacttatcaatcgtgccgcccgtatggccgaggccgcggccggacatcttagcaaccggcacttcaagagccgcaacaagcggagcaagaacgagcgttgtcgtgtcgccgacgccgccggtggagtgtttatccactttaattccttcaatggcagaaagatcaatcgtttcaccggagttcaccatagccatcgtcaagtccgcgcgttcacggtcactcatatcctggaagaaaatcgccatagcaagcgcgcttgcctgataatcaggaatgcttccgtctgtatagccgttcacgaaaaattgaatttcttcagtggtgagttcttttccgttttgttttttgatgatgatatctaccattctcatgtttggtcaccgatccttttcgattaagttcagtaaatcaagcccacaattgctgctgataaaaagctgacaagcgtagcaccgtataataatttcaagccgaaacgagcgacgacatttccttgcttttcattcagtccttttacggcaccggcaatgattccgattgaggagaagttcgcaaatgacacaaggaataccgatacgatcgctgttgtacggccgctgaaatggaaaccgttttgcgtaagcgacgtcatggcgacaaattcattcgataccatttttgttgccataatgcttcccgcattaacagcttcattccatgggatacccacaagaaaagcgaatggagcaaacacatatccaagaatgccttggaacgaaataccgaatactgcattaaaaatgccattgatcaaggcaataatcgcgacaaatccaatcagcatcgcagcgacgacaaccgctactttgaaaccgtcaaggatgtattctccgagcacttcgaagaaggattgtttttcctcttcctcaacacgaagcatatcctcttcttttgcaacctcgtacggattgataatagaagcgataatgaaaccgccaaataagttcaaaacaagcgctgttacaacatattccggtttcagcattgtcatatacgcgccgacaatcgacattgatacagttgacatcgcagatgcacaaagcgtgtacaagcgctgctgatttaaaagaccgagttctttcttcaaggagataaatacttctgactgccctaaaatcgcagaagccactgcgttatacgattccaatcttcccataccgtttaccttgctgagggcaaggccgatatatctaataataaacgggaggactttccacttttgcagaatcccgatcagagcggaaataaacacgattggcaagagaacattcataaagaatgtcgtttggtccgcattcaccaagccgccaaacacaaagttaattccctctgccgcgtattcaagcaggtaaccgaatccttttgcaaatcctcccacgaggaaattccctattccggtattgaggagaatgtagccaagaataaattgcaaaatgagcataacaacaattgggcggatcttaattctttttttgccgctgctcgcgatccacgcgaggcctaaaaacacgagtaaaccgataatcccaatcaaatacttcatatgtgtttctcctttatttgtattcgcttacaattactgtttcctcagaaaacggaaagcagtctgccttccgtcagctcttaatagttgtctccgcctgatgcattttctccttttacgatagaaacgcctgcgctggcgccaattcggcttgctccggcctctaccattgtgtctacatcttctttcgttctgacgccgccagatgctttcacgccgatatcaggtcctactgttttgcgcattaaggcgatatcttccttcgttgcgccgcctgtagaaaagcctgttgatgtttttacgaaatccgctcccgcagacaccgctaaacggcatgcacgttctttttcttcatcagtcagaaggcacgtttcgataatgactttgacaagcgcttttccggctgcagcttccactacaccgcggatatcagcttccaccacatcgtcttccttgtcttttaaagcggcaatattaatgaccatatccacttcagtggcgccttttgaaatggcgtcttttgtttcgaacgcttttgtttcagttgtattggcaccgagcgggaagccgatgaccgtacaaacgtcgactccagttcccttaagctcttttgcagcaagctccacccatgtcggattgacacatactgaagcaaatttgtatgttttcgcttcttcaattagttttagaatgtccgctttttgtgtatgcggtttcaaagctgtatgatcaattatgttggctaatgacatccttcgcacacttccttttttgttaagatattttttagcataaccgacttttgaacatatgtaaattggtaattgaaattttgttcaacgaaaggtttgaacgtgtcacaaatcattaacaagcgccctcgcggtatgctggtcaatgattaaaacgttggcatattttccggttaatgctccgtgaatggaagatacttttctgcttccgccggcaactaaaatggagcgttccttcagcctgaggtcttcaagctcaacaccgatggtccggtcattgatggcgctgctgcaaatattccctttcgcatcaaaaaagcgtgaacaaatatcccccacggcctgttttttcagcagggctttctcttcttcgttaaaatatccgagtcggaacaacagcgcttcatcacggacagtccccaccgtgaagagagcgatattcgcctgctttcccatctcgatgatccgctcaatatgacggtctttctccaccattcgcttcacatccgcattatcaaacacgacgggaagcgggagatagcgcggcatcgtttgaaaagcctctgcaaacagctgaatcgtttcagccgaatacgtgtttacccgggaatggctgatgccgccttttagctggacgacctcgacgccttttacctgcttcggctgcatgttttgcgcgatttgatacatggtggttccccagctgacgccgacaatgtcgccgtcttttaccgtttcatgcatatattctgcaccatagcggcttaggtcatgtgtaattcctgcataatcgggtgtcggggaaaacacaacatgcgcctcaaggagcccgtatttctcttcaagtatggaaccgagcgcatccaaatcctcaaatgggtccatgacgcgaatctggacataccctttttcctttgcatattgcagcagccgggaaacggttggccttgaaatgttgagctgctcagcaatttgctgctgactgtagtcagactgatagtaaagccttgccgcttctatgcttaattgttgtttttcccgatccattccgcacctccctgtggatcagtcctgataaaactgcttttgatttgcttttattatacaggctggcgccggctttcatccacctgatttctaagaaactgaaaaacgctctgggcgcggacctgcccagagcttacttctcccaggtcatatgctgataaatgcctttcataatggcgtacattccatataggatcaggcctaatgccaacatagacagaatcaatttgccatgcggctgctgcgcgagttcggcgagcgcgccgtcaaagcctcttgtgtcgtcgggatcagcggtcatggctgtcttgatcagaaaatagccgatagcagagaaaataatggcccgagcgatattgcctgcgcgcccggtgtttttcgtgatgcatatcatctgtttgttcatttttgatgtatcgaattctttcataaaagcagcccgaacgcctttcataaattgaacaatcgcaaatacgataaaacccgcacccgtaagccctgtgagccattggccgaatggctgcgccaatacataagcggaccacgtctgttctgaagtgccgccgtccccttggccaaacacaaatcgcaaggcattccaagcgatggatgtataaacggcggcactgaaaaagtttcctattctccgtgacaggcctcgcctgctgtttccgtgcccctccgtgtccttgatcgcacttaacaccatccagattacatagccgataaggccgatgcctattaaaaaaagcaatagtgacccatacggcatgcgtgatagcgtttggagagctccgctcgaatctttggcgcggcctgccccggcagccgtcataaaagccaaaaccccaagcagaataaaaacgccgccgaatgcaaaataaccaagcctcccgaatcgtttgatccaaggcttggtttcctgttttatttttgacatgtaccggtctttcaccgccatgtgtccaaccctctttcacagaaatctttactgtaacattcccgattggacaaagttgaaacagcttctgcctcagctatggctggctgagatacgtttttgctgtttagttgattgtgcaggtgtcatccaagcagccgctgcggcagctgtgactccgcctgctaatttcccaatgatcatggccgccgccatttcttttttcattccagctacaaaaccgagatggctgcctagtacaaaggcgccgctgaccgcaaacgcgacattgatgacctttcctctcggcgtcatattctttaatgaagcaagcattgggatatgatgcgccaaagaggtcactaatcctgctgttgctgtctcatctaaatgaaggtgtttccccagggcctgaagcggttttttaaaggtttttgtaataaaaaccgtcattggaaacgcccctgccagggcaatggcgatggtccctgtcgtttgtatccctgtctcgacattctccattcccggaatcagcacaatgccggtcatcgtttcaacagaaacagctgcaagcccgataatcgcaaccacactgaccgctttcccaaagagatgaaacaactgaatcattctgtcggtgtatcgccataacccaaaagcgatcacagcagataacagactcgggatcagaagatttttacctatcatgccgatgtcaaagcctgcgcataatccgccgattaagcaaccgatcggcactgtgcacagcccgattaatatgcctttcgcaaaatacggatggtcctctttttcgatgatgccaagagcgacgggaatcgtgaagacgattgccggtcccatcattgttcctaaaaacacccatgaaaacagcccggcctgcggatctttcgccatttctccagccagcgcatatcctcccatatcaatcgccaaaatggtgttcgcaaaggaagaagggtccgcgccaatcgccgtgtaaaacggagcaacaatgggaatcaggattgctgccagcacgggcgccagcgacacaattccgatcatggacagcgccagcggccccatagccttaaagccgtccgcaaaccgctcgcctagcccccatctgtttcccaaacaataatccgccgctccccatagtaaaaaggcagccaaaatgaatacaaccgcgtcattcaccgtcatggttttctcctttttcaaacgtatgattggttttatcatatcatctgaaatcaccgaatagagttgatcttattcaatatgagctaaaaattcttttatatcggctttttcaacggctgttatgattctccgcgctttttcttgcgggaccgttaatgtcaatttttcttttatgtcttcttcagacagctcatttcctggcgccccttttgggcagtccacacgcgcttcgcaaatccggccgtctgataaataggcccggacaatcgtgaaacggccttttggaacggcatgaggagccggctgaatagcattgtcatatacgcgctgaattcgccccattgtcgtttgaaccccgcttgggatcggctggctgctgaaatgttcaacggtcaggccgtgtccatgcaaagcaagagcaatcacatattcaacgctgaaacggccttcctctccagtttttggagatctttccgtcaatgcagcatctccgcctggcggaaatatcacttcaatacgttcggtattggcagcagaaatggtttcttcggagataagctgtcgtaccgcatctgcagcatggtgtgccgcggaacaaaatggatagattttaaaccatagacccggctgcacaattctccacggtgccccccaatcgtttagcaaagtgtgttgtgctttttcaacgtcaccgtacagactgaagaaaccagtttctccatcaaatgccgtgcgggacccgccaaattctgattgggccagcttaacggccagcaagccagcctgagccgccaaaccggcgtgcagtggtttcatttctgttccaaattgcaccctcatcccagcagattgtgtagccgcaaaaccaattgctttttccagctcttcctgagtcagcgcctcagcataacctacggcgcaggcagcagcgatggcaccaagcgttcctgtattatgccagcccttttcatagtggcggctgccaattgattctcccagccgtgccatcacttcaacaccaacaatataagcgccaagaagccgctcgtcatgtccgcgagcggcagatgcaataagggccggtacgatgacggcactggggtgtcctcttacatcggagtggacatcatcaaaatccaatgcatgggcgataaatccattcagcatcacggattgtaatggcgcggcctttttgccctgtccgataataggaacaaggggccggcctccttcatcctctatcagacggaggagcttttgaattcctttatcttctcttcctgcgaatgaagcggcagtaaaatcaagtaatcctttttttgcttcgcgaatcgcgtcaactgaatgctcaggttgtgatgttctcacagccgctgcaagacctgctgtcagcccttgtttgctcatttgatggtctccaatacaataaccgccagctccgcaaagtattgagaggcaaccgtaagggcttcttcatccagtgtaaaggccggatgatgccactcctccgtcccgttcgttcccatccagacaaaaaatcccggaatcttctcttgatacagagcgaagtcttctccgcccggagactgctcagcgtgaacggtttgatagccaagccgtgccgcagcttcggatgccgcattcaaaaatgtgccgtcattctgaacggaaggcaaataaggaaaccacttgaattctgcttgtgccccatagcccgctgcaattccttcagccactcgtctcatatgctccggaacagcctgccgcgcttctttttgaaaggttcgtaccgtcccctccatttcagcttggtctggaatcacgttccacgatgtgcccgcctgtactcttgtgatactgacgactgcgttttgcagtgagctgatattgcggctgaccacagattgcagcccgctgatgatttgtccggctgcagcgattggatcaatactgttatttgggatgccggcgtgtccgcctttccctttgatgacgatctcaaaccggtcaacacttgccataagcggaccttcctttacaccaatggttccgacaggcagatccggcttattgtgcatgccgaaaatcgcggaaatgccatcaagtacaccagcttctatgacctttcttgctcctgcggcaatttcttcggccggctgaaagataaagcggactgtacctttcagctcggcctttctttgattcagcaaaatcgctgtgccaataatagaagcagtatgaaaatcgtgtccgcacgcatgcattgtgccatcaaccttagatgcaaatgggagattcgtctgttcttggatcgggagcgcgtcaatgtccgctcgtattgctatcacggggccgtcttcccgtcctttgatttctgcaatcacaccagtctccaattgaggaacatcaagtatttcgatttgctcctcctcaagccagcggcggatttttttcgtcgtttcaatctcttgaaatgacagttcaggatgttcatgaagatcacgccgcatattgattaaacgggtatgaaacgctttgtcggccattgttcttctctccttcttatataagctctgcaggctctcccacctgcttgataaatcgtttcgtccgttcgtttttcggatggtcaaacaattcctctggcgttccctgctcgataatatggccgtctgccataaaaatcacttgatcagcaacctcttttgcaaacgccatttcgtgtgtaacaatgatcatcgttgtttgtttttccgcaatggacttgatgacctgaagcacccctgtgacgagctcagggtcaagcgctgacgttggttcatccagcaaaatcgcatgcggattgaccgcaagcgcccgcgcaatgccgattcgctgctgctggccgccggacattgtgatcggatagctgtcagccttatgctccagaccgacttgtttcagaatctccattccaatacgtttcgcttcgtcgcgtggtttatgttgagccacgattaaagcttctgtaatgttttgcagagccgttttatttttaaacagattgtagttttgaaagaccatggccgtttgctggcgaagccgatgtgcttccttgcgtgtaaacttttccgcgttcagtttggcttctccgatttcaataaggccttgatccggacgctctaataaatttaagcaccggagaagcgttgactttccggaaccggacggaccgatgattgccaccacttctccgcgtttcacttctagatcgattccgtcgagcacgacgagatctttaaacgctttacgaatattttttactgttatcaactgatttcacctctaattccggtatggcttgctcatggcacgttcaaacaagtcctgcaacatgctgtagataatggtaagaacccaatagacgatcgcaaccgccaagtacgtctcaaaatatttgaggtttcctgaagcgtacatcttcccttgggcgaacatctccatgacccctaatgtaaaggccagtgacgtttctttcaggagcccgataaatgtattgcccgttgccgggatcgcatttcggatcgcttgcggcaaaataatccgtctgtatgcctgaaattttgtcataccgacagacaggcacgcctccagctgcccgtcatcaacagaattgagggcggcccggaagatttctgccaaataagctgcgttttttaagcttaacccgatgatggcagctgtgagagctgtcattttgctcatctctggaaatagctgcggcagcccgtaatagattaagaacagctgtacaagtgtcggcacgcctcggaaaaaggatatatacagctttgacagctgatgaagcactggaattttgttttttgtaatgagtgcgagaataagtcctccgataatggcaaaaatcatagctgctatggccataaacaaggtgatcggaagggcctgaattaaagtcgggaacgctgatatcatgaattcccaatcaatcgtgttcattctggtgagtcaccgccgtttcttaatgcttctgttctactgtgatatcttcattaaagtatttttcagagagttttttcagtgttccgtctttacgcaattcatctagggccttattgacttttttgcggagcttgtcgtgcgcatcgtccttggcaaatgggaatgcaacctgttcgtaaacaatcggatctcctgcaagctttaatggcaaaccggtcttcttgatttgcgcgatcaatacagttcggctgttgacataagcgtctacacggccgtacgcaacatccttcagcgtaccctcttgtgtttcgtacgttttgatattgatttttttatcaggatctttgctttcaaggtttttcgcgtggtttgaaccgagaacggctgcgactgtcttgccttttaaatcgtctactgatttgatgtctgtattgtcttttttgacgacaatctgtgttcccgcataagcgtatggtttcgtaaagttatacgtttccttacgttcgtctgtcacagctacctggttggaaatggtgtcaagcttgcctgtttgaagttctcccatcagcccgctgaattcaagcagcttccagtccagtttcatgtcaattttcttagcgactgcttccatcacttccacgtcaaaacctgtcagctttccgttttctttataagcaaatgggtaactttgtcctgtcgcaccgacatgaagcacattgtcatcctctttactgctgctgtttccattgccgcaagctgagagcaccgctaataatgcagcaacgaccagcactgtccattttttcatcttcatttgattttcccgccttttctatttttatagatcatgtcgcaattgttttttcatatagactgtgatatgcccttttccaaggtcttgttcacctgagcggacatatccttttcgttcgtacatctcaatcagccacggatgcttatccgctgttccgagtgagacaaacggaacctttaacgtatcgcgaaggattgtttcctccagccattgaagcagctttgttccgattcctttttttccggtgtcggggtccacagcaaaccaccagatatgcggaacgccatacggtcccggctgttttccccaaggcattctcaaggtgatggtcgcgatgacccgcccgtcttcttccatgacgtagcaagcattttcccgaatatttttcagcaccaaatccaaatccgcatgagcggcagcaaaacgaatgccgagctttcgaatcggttcataagcccgcaatgtcagctcgagaagctgttcggcatcacgttcaactgcaaggcggtatcgtggcttcatctagcgttcctccttactttgcatagcggtttaccggcttttccaaaccgaaatgctctcgtaatgttgtgccttcatattcttttctgaacacgccgcgctcctgtaaaatcggaaccacttgatcaacaaacacttcaattccttctggaagaagcggaggcatgatgttaaacccgtcacacgctttcgtatccacccattcctgcatcttgtcggcgagctgctccggcgtgccgacgaagatatggtggcctctggagcctgcaacgtatttgtaaagctctcgtatcgtcatattgtcacgttcagccatctcctgaacaagcttgaagcggctcttcaccgcattggaagcttcggcgtcaagcttcggcagcggcccatcaagcggatatgccgacaaatcaattccgcctaagtaattttggagaatttgcagaccgacagatgggataatcagatcttggagctccttgtatttggcttgcgctgcttcttctgtatcggcaatgattgggaaaatacccggcataatggcaattttttctggatcacgtccgaattccgcagcctgttctttaatggattgataaaattcctgagctgattccaggtggttttgtgctgtgaagatcacttctgctgttctggcagccagcgcttttccgtctcctgatgatcctgcctggataatgaccggctggccctgcggggttcttgaaacgttcagaggtccgcgaaccgagaaatattctcctttgtggttcagctcgtgcattttttctttgtcaaagaattcacccgtttctttattacggataaaggcgtcctcttcccatgaatcccaaagcccctttacaacctcgacaaattcctctgcccgctgatagcgcaaatggtgttcaaggtgcttttcaccgctgaaattcagcgctgtggattcaatagatgaagtgacgacgttccatccggcacggccattggacagatgatccaatgaagcaaactgtctggcaatatggaatggctcgctgtatgtagtggaggctgttgctgtcagtccgatttttgatgtgacctgcgccaaagcagagagcagggtgaatggctcaaaccttgttaatacatttggatgtgatttgctgtcaatagaaaggctgtccgctaaaaacagcatatccagcttgccccgctccgctgttttcgcaagctctttaaaataatccaaattcatgctcgcatctgacggcgcgtccgggtgccgccaagacgcaacatgatggcctgtacctgctaaaaatacccctaatttgatttgtttctttttgcttttcatgacgatactccttttatcatgtttttaggctgaataatccgaaaaataaactcctatattcctagtcgtttaatatgaataaatcaaaatgtacctttgtcttggacgtttgtcaatgagttaagattaaatttttctttttaagctgaaaagaatttcgcagtatcatgggacggcatttgtgcaacctgtatactggcaaaaccagtctgatgctgaacctcgttttgatccaagttttatataaatgtagcttgtaccttatctctcatccgaccatacgcattttgccgtcgcttttgctctttgctaataaacgcgcgtgtcgccgtcgtagaacggtccattttccaactcattcagaagctgagacatcacataaaaaaataagctgatcccggattcataccgaaatcagctaattgaatcttaattaagttctagaatactttcttctgctttagcggaaaacactttaggctccaaacagtcaaggtcttcatgaaataaatttactttttggatttgccgattgtcatagtggtggaaatagtagtttccagtttcgttgcacatcacggaagtatattgcgtataatgaatctcgtcttcttccgttatcactgcgccctttggtatcgtcatatttgccaaaatgtgaaaagcggctgttacacctttcgtttcatcggccgccggctctagatgttctttcaaataaacagctctgacaaaccgggaaggcggtgtataatcccccggcagaccaacagttcctaagccttggccaaaagcagaaagggctaatccgcccatctctttgctctctaattgcttcggtctgattcctgtatattgctgcagattggttacatgccatataaagtcggggctgttcgtcatgacaccaggttgattgtcatagagtttgaagccgtctgctcttggttctatcgtcaggcttcggcccgtccggtctgacaatatccagtgaagcggtaaaactgtatccaatagatctaattttttctctacaatcgttaaagatcgaatcttttcttttacgtcttccaaagactgacagactgacagcacccatgtcacaaactcatgcggggcaatgtgaacggtatcttcccgtatcgttttttcgtactccgcatagccaggaaaataaagtgcagcacacgataaaccgctttcattaacaccgtcggcaaataatatatttccaagttttctccccataccgataaacgcgtactgtgtctgatgggcctttccgtcagcttcactattccagctgtaacggcgcggatagagaatcacctctgtccccagctgaaatgcaaaatccattgttctcgctaataaatgattccggtcagcagtttccaatgtaagacttgtgcacatttgatcagtccccttttcaattcagattaatatcatacatattgtgaacgaattggttttatcagcataacgaaagtcaaatcggttcgtcaaagaattgacattacatcaaataaaacgaaaaaatccagcctttagaaggctggattttttattatttagccaaaacaagctcgtgaatcgcatgcgcaacaccatgttcattattggagcgtgtttgaaagtttgcggcttccaatacttctgggatggcgtttgccatggccacccgcagcccgcccattcgatcattgtcaggtcgttcccgttgtcgcctatgcacatgacttccgcctgttcaattccaagcagctgagccagctggcgtacagcatttcctttgctggcttccgagtgcagaatttcataaaagaaaggcgcgcttttgaccattgtatatttttctctcacgtcttttggaatcgatgtaatgacgcggcttaagttctccggtttatctataaacatcactttcgggatgaggatatcttttggcacctcgtcaatcttgcggaaatgaagcggcacctgtgtcacataggattcgtatacggtaaattcgctaatatcccggttaggcgtatacaaattagatgagtcaaagaaatgcatcggcgtcttcagctctaagctcaggtcatataatgaagtcaaatcatcatagccgagagacagctccgagaccacttcatttgtatgcgtattttgaacaagcgctccattatacgcaatgacatagtcgccttcttcaattaaattcagttcatctaaatatctctgcacgcccccgataggccggccggtgcaaagcacaattttgacaccttccgcttttgccgcgtgaagggcgtcgcggacctcctctgttacttcatgatgatcatttaaaagtgttccatccatatcaattgcaattagtttgtacatcctgcatctccttcatgtcgttttcaggctatagtcccatcatatcgttttttctttttgatattcaaccggaagagatggttttctccggattctgtttagacgccgcccttgtcttcggatacgcaagcgcggtttccgctttctttctgccttgacgccgttttctgcttttttctgtttcatcagcagaaagccggcagctagaaaaggaatgccggttatattcaagatggcaagcttcacacccgccgcgatgaaaaagaaccccatgaagatgatggattccgtctgatcatgacgtaagccgccatttccagaacgatcaggatggcatgaagcactatgccataaatcagcaatacaagggcaaaaaacaaaacataattcacgattgcccctgagtacatcatagcgcgcatcatttgtataaacgataaggactgcatggagccgctgattacattagggttatagatcgtatagtcactaaataaatgtttgactttgagaaaagcccataatataaatatccattgaatgatatgtaaaacaagccccgctgccaccagtctttcagctttttgatttctcatctttctcctccctgccgttctttgattcgattcttgtcatcgtttttgtctggccattttgctcccatatcaatgtcccgttttctcctcttttcagcgtgcttttgagcggataataggggccgaggtactgaatctcgatagacccgtcagtgctttgggaaatcaccttgtatgccataaaaggcagctgtacctctcctcttccttccatcacttccgtttccacaacctcgtcttcggtaaatgtgactgttgctgatttcacgccgtccgttggcccggggcaagcccctcatcccacgttccgtaataaaacggcgtctcttctttttgctgctggcagcccgataccatgatgcatacagcaattaaaaacaaaatgccatatttgtttctcaaggggatcaccatcctttcctcctctttttgggcgaatgccgtgccactgtgccaatgactacataagttataaggaattcacccacaaggagattgatcataatgaacccttatcaatattacagccctcagctgcctcagcaggaaccttactatagccactatgagtacaatccttatccgcagcaggatgtatacgatccataccaaatggacagacagccggcattggaaagaagaatcgcagcacttgaacggcaaaatgaacagcagtcaagagaattaacccgtctgacaaacgaagaccgccgtcaaaatcgggaaattgcacggattgccgaacaggtcaatcagctaagccaggctgttgaacgccatacacgccgcttaaaccggctcaatcagcgcctccgtacagtagaaaaccggctgaatatcccatttactgcaggggaaggcggtttctgagcgaaacaaagaaaaaaagcggaatacgattctcccatctcagggtttcgttttccgccattcttatatgttaaaacggaacatttacataaaaagggtttgtacccagtatacaatctttaccgttttcattcaaagacagagggctgaggaaaataattgtagttcctcatttgcagaatttcttttcaatcaggttgcatgataataccgactcacgtcaatcgatacatggagggatcattcatgcataatacacaacacggcttgcagcagctgaatcaatgccgccagactgctcagcagctcattcagcaaacacagcaaagcagccagcaatatcgccacatgcttcatcaggaacagcaaaacatccaaatgctgcagcagattctaaaccacgaacaacaagctgcacataccattcagcaagcactgcacgggcatgacatggcgattcaaaagtgccagcaggttgtcaacatgtgcaaccaaatgcaacaggaacttactggacaatccagcgtcatgaatacgaatgtgtctacacttccattcggccaaaacacgccatttcagcagcaatcctatcagcagtaacatataaaaagctcaacacaatgcgagtgttgagctttttttcttactgttctttgcgaatatgtatatcctgaatagactgtttcggtgcatgaaatctgctctcggcttcacttcttgcctcggcaaaagcccgcgcctccacatgatctttgtagacatccagctgaatcaaatacagcgggcgcactttaaatccatgaataatggtcaccgcccataacgggaccacaataaaaacaccgggcagatcgggcaatacaaaaccaaacgcaaaaatgaaaaaataaatgatgccgtacatgatccactttctatttctaaccttgatgccaataaataaaaaggcaaaaaaactggtaatggcaaaaggcatgaaaataaacagcatccaccagctatgcagccattcccaagcggaacctctttttgtaattcccatatttttctcctcctatttacctataataatcgattaggcataccgcgtcacccataaacgggaaaaactttctcccttaaaaatagtgatagacggggaacaggtttcttgctatattattaattgataatgataatcattactaatctattgagatacatagtgggagggttcttgatgaaaaagaacatattgctcgtgggcatgcttgtgctgcttctcatgtttgtcagcgcttgcagcggcacggcttctaaagggagctcaagcgattctgcttccgaaaaaacagaaatgagaacatacaaatcaccaaaagggaacgtcaacattcctgcacatccgaaacgcatcgtcactgatttttatgccggtgaattgctgtctgtcggggccaatgtggtcggctcaggctcatggtcatttgataatccgtttttaaaatcaaagctgaaaaatgtgaaggatgtcggtgatccaatcagcgttgaaaaagtgatggagcttcagcctgacttaattgttgtcatgaatgaagagaatgttgataaattaaagaaaatcgctccgactgttgtcataccttataacacagcgaaaaacgtagaggacacagtcagcatgttcggagatatcgccggagcgaaagacaaagcaaaatcatttatggctgactttaacaaaaaagcggaagcagctaaaaagaaaattgccggcgtcatcgacaaagatgcgaccttcggcatttatgaaaacacagacaagggcgaattctgggtgttcaatgacaatggcggacgcggcggccaagctgtatacaatgcacttgggttaaaagcgcctgaaaaaattgagcaagatgtcatcaaaaaaggagagatgaaacagctctctcaagaggttattcctgagtatgccgcagattatatgttcattacggattacaacccgaaaggcgaaagcaaaacactcgacaagctggagaattcctctatttggaagaaccttgacgctgttaaacataatcgcgtgtttatcaatgactttgacacgttctacccgtacgacccgatttctgtcagcaaacaggtggatatcatcaccgacatgctgatcaaacgggccgaagaaaataaaaaataaaaaaacggcacagtcatgacgctgtgccgttttttatgattcactttaattttgactgtacggagtccggcatatcttcaaacttgacttcttcccaagtctcgacatactttcctttcgcctttaccttcaaatacgcgttcttccgaagctctttgccggcgaaaaaggtcacttcttcttttttcccggatgcattatatccgtctaatgtatattcagtaccgcccggactaagatgtctgccatctcgatcaatctgaacatagacatcttgctggtgaataaacggattaaatctgtctgtaacatcgttatgaaaaaagagaagcccgcatattacggcagcagccgccaagacggccaggattgccattgcttttttcatctttgcactccccttacttgttcatttttttcaaatagcttgaccgcaccgcgaggaagaatagaagctgaaaaatgaaaaaccctccgatggtgagactgagcggcccgcgacatcagaatagccttccacagccaatgttctcaaggcaaacagtgtatgcatgacggcaatgacaaatggaaagaagaaaagaatcgccaattgtattgtcacgctttgtgccatttcacgctcactcaggccgattttggccagtgaacggtagcgctcccggtcttcatctaaatcagtgaacaacctgaaatataagaaacttgctgccgcgacaaagaatacaattgcgataaacaggccgataaataaactcaggctcggcagctgcaccgtatcatagtaagtcccggcttttgaagcaaaatcagaatgcacgtcgatataattgccgtaaatctcattttgcaaggattggctgatctcaagactgtctttccaatgatcatagctgtagccgtataatgacgctttatcaccgagtgatttcagctgatcaaaggtttgatcattcaccgcgatgatggcattcaatgagatcagcggttttttgacttcttttaccgacagtttttgatcagacagctcccctttttggttcagcagcttcagctgatccggcgcttcgtttttgaaattgcggtcatacgttcccgggaaatagacagcctcgtcttctttcaggccgttcactttgacatggaagtattttgccgcatccgattcactgatcatgtaaacagggggaacagtttctccttcctgatagcgaacataggaaacatctattttgtctttcttatacgtaaagccgtgtgttttcagttcatggtcaatatctttcaaatgagtctgttcttttggattattgctgtaagataaatactccatttcataagcggactcttccgctccgacggtcgatttgtacattgcgagcacgcctgtcgcagtaaacgcaaccgcggaaataatgctgacaataaagaacaggcgggcgttgtcttttagacgatagacaaggtcagaaacccaaatgacatttttcccgcgcaaataaaaggttttccacttcttcagcgcgcgcagaatccatatgctgctttggctgaaaaagaaatatgttccgatgacggtgagcagtaaaatgataaacggttcggccccgtggacattgcctttcagaaccatgccgtacccgccgcacagacaggcgatgccgaataaggacagaagcacggacggcttaggctccggcttaaccttgccagtgccctttattaatttgataaccgtatttgatctgacaaaaaggatcgtaaactgcgataaaaagaaaaataagagcagaaatccgcaggccgtaataccgagcgctttccaaggcatatacaaaggcagcgcgtccatttctaaaatataagcgccgaccgtaaagaacgtctttgaaaaaatgaaccctccgataatgccggctgcaattgacatgacgccgatgatcatattttccgccgtaatgagctttctcagctgccccggcgtgatgccctgcatgagcagaatgccgaattctttatttctcgatttcaaaaatgcgttaaccgaatacagaacaaataagaaagaaaaaacaaagatcatccattccgcagcggttaagccttttttggcgatattattcaggtagccttcctttaatgccggatgaaacaagaacatcgcaaaggtaaagaaaatcaaaacggaaaaggcgctgcttaaaaagaatgcaagataggcccttttgtttctcgtgacgtttttataagcgaactgaagaaaggtcatttgcgtttcccccagcatagacagcacatcgagaatttgttcataaaatacttggcggttttcccgcggtaaatctcattaaacagttcgccgtcttttataaagatgacgcggcggcagtagcttgccgcaacaggatcgtgggtcaccatcaaagccgtgacatgatcatcctgattcaggctctgcatcgtttccatgacgtcttttgacgctttggaatcaaggttgccagtcggttcatcggccaggatgagtgacggcttatgaatgaccgctcttgcgatggcggcacgctggcgctgtcctccggatacttcaaacgtccgtttgttgagcaggttttcgattccgagctttgccgcgatgccttgcagtttttcttccatgacagacggcgcttctttttcaagcgttaacggcagcatgatattttcaccgatcgtcagcgtgtccagaaggttgaaatcctgaaacacaaatccgagctgcttgcggcggaaatgagcgagctttgtccgcttcaggcgatgcgggttttctccgtgaatcaggatatcgcctgaatctggacggtcaatcgttgaaatgatattcaaaagcgttgtttttccggacccggacggccccatcaccgccgtgaactcgccttcttctattgaaaatgaaatttgctttaaggcttgataggatacttgtcctttataggttttatttatatgtttgacttcaagcatattcgccatgaaaatcctccttatggttttattcttgttgatctgggctgctttcatgtagtgccgggacgttcaacataaaaatccccttgacataaatccatgttatcaagggaaacaaagcgggctatgttgttttcttaacgcagccttacatttttgtaagaaatgaaaatcgaactgacgtcccttcaccgggagacgagctgatgtccaccgtatgattgagcttacctgtaatttctttgacgagatggaggccgattcccgtagattcttggaaacgccgcccgttttcaccggtgtaataagggtcaaacacccgcttgatgtcttgtgagggaatcccgacaccgtaatctttaacttcaagcaccgtcctgtcttcatcgcggaagacattcagctcaagtctgtcactcttgcctgctgaatacttgaccgcatttgtgaccacttggccgatcgcaaatttgagccatttggcatcggtgtaaatctgatgatcatcgcaaacgttcattttcggataaacgcgatattgaataaaaaatcgtttatagctttgaataactgattggagaagctcggacagggaaaccgcttcaattttaaaatccctttcaaacaggtcgagccttgaagaataaagaagcgtctccagcccgaattcaatctgccggacttcttttttgatttgttcaaaaacgggctcatcctcttcttgaatgattaaattaatgaccgacagcggcgtctttacttggtgcacccattgattcatatacgtcacccgcgcgtccagcttggcttcggtctcatggagcttctggtgctgcagccggatcagctccatctgcttttcatacagctctgaacagaacactgaggaaccgagatacgggatatccgtcccttcctgccccgagctgagccaatgatacacgccgcggtctttgtaccagcgataggcaagatagcccgccaaaataagaagctgcacgcccaatatgtaaaacaagtgagaaaaagaatgaagacccgcaaaccagtaataaaagaagacaaacagcccttgaaggagaaaaagcagaatcagcactgcatgagaccggagaaacagcttcatgactgcgccctcagctggtagccttcgccccgcaccgcttcaatagaaacaggcgcattcagctcccgcagtttttttctgagccgcgtgatatacacgttaagtgtattatcatcgatgaatatgtcggtgtcccacgtcttttccatgagacggtcccgactcgtcaccttttctccccgctcaagcagcacttccaaaagcttgctttcttttttagaaagctcgcttttttcatcctgaaaacgcagttcaaaccgttccacaaagagctgaacgccagcatattcaaccactttctctccctgctttgcggcgtactccccgtacgccctccggatctggcttttgattttcgcaagcacaatatcataagaaaacggtttttcgatataatcgtctcccccattttcaatcgccatcacctgatccatttccccgcttctggcagaaataaagatgatcgggcttgtggagtgctggcggatctgccggcaccaataatatccgtcatatgccggcaaattgatatcaagcagcaccacatcgggcttttcccgcaaaaagacatcaagaacagctgtaaaatccgcggcgaccactgtttgatatccgtatttttcaaggtaattctgcaatagtccgcgaatgtcttcactgtcttccacaatcatgattttattcaaactgaaccactcccgtttcttacactgctgccatcatcataatcgttttgggcatatggacgcaacaccgcacaaaaaaaccgccatctcggcggtttctggtctctttagccgacctgctgcttagctgctttaccggctgatccgaactctctcattttgcttcgcactgtctcttccacggcttcaatgccgggtgtcaaatagccgcgcggttcgtacagatcgctgttttcctggaacatgcggcgtgtttcgtctgtccacgctaccatacattccgtattgatattgatcttcgcgtggccgagcgtgatggcttttttgatctgatcctgcggaatcccggatgccccgtgaagaacgaggggaatatcagtcatgcaggagatagcctccatttccttaaatccgagattcggctcaccctgatatttgccgtgtacagagccgagggcggcggccagcgcgtcgatattggtttctttgacgatccgctcacattccgtgatatcggcatagcagaccccgccgacaagtccgtcttccattccgccgaccgtgccgacttcggcttctactgatacgccgtgttttgcggcataatcggtgacttcttttgtcattgcgatattctcgtcaatcggctgatgggagccgtcaatcatcactgagctgaatccggcatcaatggcctgtctgcagcgttccgcactactgccgtgatcgagatgaagcacgaccggaacggtaattgccatgtcctctattaacgcccctaccatggcggcaatcgttttaaatccgcctaaatagtcgaccaggcgatcggaagccgcggcgatgaccggtgattgctccttttgcgccgcctgcaaaatcgccttcgtccattgcaggccgttgatattaaactggccaattgcatattgctcccgctttgcatcttcaagaagctctttcatcgatacaaaagccatgtccacccctcctttatccattacatgttgaagtattttgatacgacgtccactgttgtttttttcgctgtttgaatggcttcctcagcagtcagcttatagtattcaggccggaagagctcaaccgatacaacatcagagaagccgatttccttcagtgctgataagtgggcatctaagtcaattgccccttgtcccggccatacacgatcctcatctgttaaaaagccgattgggaaatcttctgtatcatcaatatgatagatgaagattttctttccgtccgcctgctttaagctctcaatatttgaacccattgcatggaagtgaaaactgtcaaggacaagcccgacattgtcacggttaactgtgtttacgatctcatacgcctgttcaaacgtattgaccgtacattgcggatggccgacaaattcaagtgcgatttttacgccgtacggctccgcgatatctgacagctcagtcagcacgtctacactgctctttttgatctcttcttttacaatcttctgctctgtcacaagcggaacggccaccacatatttcacaccgagggttttgcatgtttccatcatgcctttaaattcagtgatgatctcgttgtggcccttttcatcacggttgttgaagaaaacaagcgcgtttaaagcaagcggtttgatgtgatgggtttgaaaatattccgcaagatctgccaatgaatgatcttttaagtactccggcagcttatccattgtgcggatttcaatataatcatagccgtgcttttcgcatagttctaaatcctgtttaaggtttgagttttccaatgttgtcgcttcattaaaacaaagtttcatgccagactcccccatctgcgttttagatatgaagggagttcggcaggaaggctgtcgccatatcccgccgaactccatgctcagcttatgccagacctaattcttcttttattttcttaagcataaatcggcttgattcatccgctctttcatcgacccaagcaaatacggcattcgtcgcaattccgtcgaacttcatctctctcagttttctgaaaatcgtatcaaaatcaacctcgccttgaccaatgtccaaatgctggtgaaccgttactttcgcgtcaggcggattgacgatatagcgaagaccatgagccgctttatgattataggtatctgcaaataaaacatgtgtgaggcggtcgccggcttcgtcaaacatggtctcgatgtcgcctttgccgtcatcatagaagaacgtatgcgcagtcgagtagacaagattgatccaatccttgtcaagcgcgcggatcatatccatcgcacctttgtgcgtttcgataaaatcgtatgggtgggcttgaagattaagtttaataccttctttttcaaagactggcagaagctcatccatggatttgataaatttttcttcacttgttaaaggatcatattttgaaccgctgaattcgctgttcatcaaatccacttcaagttcaaccgcaatttcgattgcccgtttccaattgcgcaccgctgcctggcggcggtcttcatcgggtcccgcccagtggtaaagaggaagaagcgatgaaagcttaacacccgtatctcttaaaagacgctttaattgtttgatctttgctgaatcaactttcggatatttataaaacgggcaaaaatcctcacgcggagacaattcgatatattcatagccaagctccgccgttttatagaccgtttcctctaaagttaaatcatcacgatacatggatggatccaatgctaacttcatattttcactcctctgttttttagttttgaactgttgtaaaagattgatagaattccggtttttccttcaattcaaccttttctttttgtccagattcctgggcttttacacacgcgtcagtcgtgacagcagcaatatagccgtcccatgccgtcggtccgctgacctcgcctttcttttgaatcgaatcaataaagtcttggatttccacatcgtacgcagcaacaaagcgtctctgccaatccatcagaatatctgtgctgaatctgccttcttttctcaagctgatgcttgatggttctggaagcttgatgatgccgtcttctccgacgatttcacattgaatgtcatagccgtatttacagttcacatagatttcagcattgatgacgataccgccttttgtttcaatcacgacgatttgcggatcttttaaatgcggcagcgcgtttttcgattttttcgggtagatgacttgaacggactcgtagtcatcgttgacgagccagtgcagtacatcaatttcatgaacgagagtgtcgactacggccatatcggttgtgtagttatctcctacagtcgggttgcggtgcgcgcagtgaatcataagcggttcgccaatcacatggttatcgagtgcttccttcagctgtacgtaaccgctgtcataacggcgcatgaagccgacttgaacaaggcgtttgcccactttgatttcttcttcgacgatgcgcatgcatccttcagccgttgtcgcgagcggtttttcacagaacacatatttctgggctttaatcgctttcagcacgcttgactcatgcgcaggcccccagcttgtcactaagacagcgtctacattttcgtctgcaagcaagctgtcatcattcggataaaccgtcgcgtttaattggtattgctcaacgaccttttgtgcagcttcttgattaacatccgttacagctacaatttctgcgccggacagcttgttcgtgatgcggttaatatgttcttttccgattgctccagttccaattacgccaatacgtaaactcattgacagccactccttctgttggttacatgattttgctttctgttccttgctttacttggctctgaggagacccgtagagttcctcttgaatttgttcaagcgacttgccagacgtattcggcgcaaagagcagcccgatgatcatactggccgtcacacatccgagaagaattgcagccatcgttccaatgccgaaattggtgataatcattgggacaaacagactccaaatccctattgaaatacggacaaggaaaaacatcagtccttgtgcggaagcacgatattgcgtaggaaagatttcactggcccataactgatagttcgcttgctgccctgctccgttattgatgccgatcacgacaataaacaggagcagaatcggcaggccttcaactggcagcagaaacagtgtccacccgatcaccgccatgaaagcggcgattccaaatacggtttttctatatttgtcggcaaagggcatgaagatcaaagcgacccccaatcctgtgaagataaacagccccatttgcaaaaggttggccatgttggcagatacaccgccgacctgctgataaatgtatggcataaagaagcccatgaccccggcggctaagttccaaaccaagtacacacccatcaaaaacaatatgcttttgagatacataggcttgagcaaatcaaaatatgatgtcttattcagtacagccggcttctctgcctgagcatcctccggctgattttttgactgccaggcgtctgattccggaagcctgattctcaggatgtacgtaatcagcgcaatcacaagcagatgggcaaatacgattttattccccaagagtcccaagtctccggccagtacggagaggagcagtacaacgacagcgcccgcggcccaagcgacttgtgctacgccgcaatgcctggcccgattcttctttggcgcattttccgcaataatggtccatgacgcggttatgtcagctcctactgataaaccgataatgatgtaaccgcttaacaacatggggaaattaaccccgaacaaaaccaaacaaatccctagtgcataaaccagcatactattggtataaacagccttccgtccgactttatcagccagaaacccgccaagcagcgcgccgacagcggcagaaatcgcatttgcgctcaacgcgccgagcagtccgatttgtgtatcggatagcttaaggtaactgacccataatgataaaccggcggagcctgccacaattgaaccggcatcaatatagttggccaatgctgccgcgattgtccgtttattgaaggctgaatctccattggtattgcccatatgttcattccccattaagccagatccaacaactgctgatcaatatagtttctcgcaatcaatgcatactccagcgggttggcaacatcggggtcctgttcagcttcaatgacaatccatccggaataactgtgcttcaacagcagctgatatacttctctaaagtcaatgcagccgtcaccgggaaccgtaaacatgccttttaaaaatgattgccggaacgattgtccttcgagcctgcattgttccatgacattcaggcgggcatccttaaagtgcacatgcttaatgcggccgatatgcttctcaagcatccccatgtaatcgccgtcagaaatatacgcatggcctgtatcatagaggaggtgtacatgcgcagggtcagttcctgccatcaggcggtccacttcttccgctgtttggacaccagtgccgagatgatgatgatagacaagcttcaagccatgctgagcggcaatttcgccaaggtgattcagcccttcgcaaagccgctcccattcatcatccgtaaagtgcggcttctctgtgaacacatttttctccaagccttgcacgctgtacgtttgttcagagacaactgcgacatccgcgtttacttgctgcaaatactcacaatgcagggtaaatgcctttgccgcttcaccaagtccgtcacgcaaaataaaactgctgaaccattttcctgcaatgcgtaagttccgaagcttcagctctttgttcaggatggcaggttcggggaaaaagcccccgacctccgtgccttgaaaacgtgcgacaacgatatcacttaacaaatgctgaagtgtatttcccgctccaatttcaggcatgtcatcattccgccacccaatgggagcgattccccacaggatttcatttttgcccatctatggtgcctcccctctaatactgcttcgcagattccagctttttctcttttgcttcgtatgccttctgaacgctttcttgttcagatacctctgccaccccgacatgccaccagctgtcatagccgtccgtcattgttttaggcagcaccttcatttcaattaatgttgatacatcctgtttcttcgcatcctctaacgccgcttttaattcttctactgtgtttgcgcggtaggttttcgcgccgtatccctcagcgactttcgcgtaatcgacattcaggatttggttgtcatctgtgcggaactcgcaatagtagctgccgctgccgtgatccatttgcaggttgttgatgcatccgaatcctgagttgtcaaagagcagcacattgattttcttgttgtactgaatcgccgtgatcaattcagaatgaagcatcaggaagctgccgtctccgacgattgaatacacttctctgtcagggtgggccagtttaagaccgagtgtcccggacacttcatagcccatgcaagaatatccatactccaggtgatacgtattcggaacattagaatgccacagacgctgcaaatctcctgggagtgagcctgctgaacagatgatgacgctgtcttcaggaatcgtctcgttgattgtcagcaatgccgttgtttgcggaagctccgtattcaacgcgtcagcatattcattcaggacctcttgagaaaagtgatttttgatttccggatcaaatgcttcccgcttaaacgtcactttgctgagacgctcgcgttcagctagccattcgtccttcagctcccggatcgttgtgccgaactcgctctcatagccttcaagcaagccgtgcagtttgccaagcgtcactttcgcatccgccaccacttggaatgcatcaagtttatacgcctgcattcggctgacgttaatgttcaaaaacttcgctttatcaaaatcaaaagcggtcttagaggatgtcgcaaaatctgtataccttgtgccgatgccgataatcaaatcagcttggcgggccgctttgtttgccgcaagtgtacctgtgatgcccattccgccaaggttgttcgcaaaatctgcctcaacggtagactttcctgcctgcgtttcaactaacggaatgttataggcttcagaaatggcaaccaattcatcgcgcgcaccggaatattttgcgcctccgccgacgagaatcacaggttttttgctggatttaatcagctccgccgcaccttgaagctcgcgctcgctcggctgcatgcgatcaatatagtgaacccgtttgacgaagaaactttcatcaaaatcgtatgcttccccttcaacatcctgagaaatacaaatcgttgccggacctgcttttgccggatcagtcatgacttcaaacgcgcgcagcaaactgctcatcagctgctcagggcgcgtaatgcggtcccagtatctcgatacaggtttcaatgcatcgtttgtcgtaatcgccgcgctgtattcttgctccatttgctgcagtacagggtctggctgtcttgtcgcaaatgtgtctgccggaatcaagagaactgggatattgtttgccaatgcagtgccggctgccgccaccaagttagccgctcccggtccgacggatgtagacactgcatatatttttcttctcagcatttgcttgctgtacgccatggccgcatgcgccattccttgttcatttttcccttgatagactttcaaatggcctgcatcctgctcaagcgcttgcccgatccctaatacgtttccatgaccgaaaattgtgaaaatcccttcgacaaaaggctcttcctttccatcaacatggatgtactgctggtttaagaatttaatcagcgcctgcgctgttgttaagcgaattttcttacccacaaacgatcccacctttactcgatctttttcaattatgactgtgcttcaataagctgtacgatttcttccgcagtcggcatcgcttctgacgaactgtgcttgctcaccacaatggaagctgaagcactgccgtatttcaatgccgtttcaatgtcttttccgctgacaaggccatagataaaggctgacgcataggagtcaccagctccaaaggttttcagcacttttgtcttgtacgcttgggcgcggaatacctcgccggatttgctgtatgcgtaagagccttcgacgccgtgtttgatgacaacgaggtcggctgaatggccaaataaatgattgacggattcttcattgcttccgcctgtgcggttttccatcacatcaaattcatcgcgtgtgccgatgacgatatcagactgctcggcaaccaaagaataataaacggctgtttcatctgatgactgccacgtatacgggcggtaatccagttcgaacaccactttaacctgatgcttcttagcgtattgaacagcttttaataccgcttcccgtgacgggcttttggcgagcgctgtcccggaaacaagcagcattttcgcatttgcgatatagtcctcgcttacctctgaaggctcaagataaagatccgccacatcatcgcgatacattaaaatgctgcattcttcagggctgaggatttctgtaaatgcaaggcctgctttgtgtccatcttgatcaacaaccatctgtgttgtatcaacgccggtctttctcatataggactctatgaatcttccatgctggtcatccggaattttgccgatgaagcccgcttttaagccaagcttcgcgctgccgatcgcgatattcgcaggtgaaccgccgacgtatttggaaaatgtcatcgtctcttccattgggcggttgtattcgactgcgttcaggtcaatacatgcccggccgatggcaataatgtcaaaagccttctcttcattgaatgtatacttcatcgtaaacagccactcctcacttgttagcgttctaaaatccactcatgcgccgggtcgttatgaaacttccattttcgcgtcggccctgccatgacatttaaatagtaggatgtgtatccgtccggaacgcctaccgggtggtatcccgcaggaacgatgacaacgttttcattttccacagtcattgtctcgtcaatagaacggtcatctgtgtatacgcgctgaaatacaaagccctgtcccgggtctaactcatggtagtacgtttcttctaagaaagattcttccggcaagttgtcttgatcatgtttgtgaggcgggtagctggaccagttgccgctgtctgtatagacttcaactactaatagactgttagctgaagggtctgaatccggaagaatgttatgaacagtacgtttgtttgaaaattgcccgcgatgttcaattccgttgtcttccgctttgatcagctttgtcggaagctgcttttccgatggagaatagcaaagcgccactcttgcgttgctgaccgctgtgatctcaaatgcacggtcatttgatatatagacgctgtctgtcggttttcgttcaaatacactttcacgcgtgccgatattctcaaaagtcgactcataatctgtcactgtaatttttcccgttaccgccacaatacagatttcttgttttttcaattcttctgtatagcttgaacctgatgcaagatctaacactttaaactctacataagtgagatcagagttggatgtcgttacttcgtgcacgagtttgaccccattagacacttcatgcgactgcggcttacgcaacaaataactcatagtgaagccctcctctttctattggcagaatgagtccgaacagcgcacatggacgccgttcggctgttcgtcgtttagttgaaatcaggtgccggatatcttgccgttaccacttttttacgtgtatagaagtcgacgctgtcttttccgttcgcatgcagcgttccaaagaatgaagatttccagcctgagaatgggaagaacgccattggagccggcaccccaaggttgattcctagcattcccgcatcaatgttttcacggaagtagcggattgcgtttgagttggatgtgaacaagcaggcgccgttcgcaaactcagacttattggcgatttcaatcgcttctttcaggtttttcacacgaatgacagataagaccggagcgaaaatttcatctttccagatcgtcatctctgttgtgacattgtcaaagatcgtcgggccgacaaagtagccgtcgtctgacacattttcacgtccgtcacatacgagtctggcaccttcttcaagacctttttcgatatagctgagcgtgcgcttcttgttgtcttcgcgaatcaccggtcctaagaacacgccgtcatcaaggccattaccgattttaatgtccgccactttttcctgcagcttcgccataaattcatcggcgattccttcttcaactgtcacaaccgcacaagccatgcagcgttcaccggcagaaccgaaggcagctccaacgatgtttgtgaccgtgtcttcaagattcgcatcgttcaagacaatcgtatggtttttcgcgccagtcagagattgaacgcgttttaagttttcgcttccttttttgtagacgtattcgcctactggcttggagcctacaaatgaaattgctttaatttcgggatgctcaaggatgccgttcacaacgtcatgcgcaccgtatacgacgttgaacacccctttcggaaggcccgctttttcaaaaagctcaaccaatttctctgttaacagcggagtccgctcagatggctttaaaataaatgtgttgccgagcgcgatcgccatcgggaacatccagcaaggaaccatcatcgggaagttgaatggcgcgattccgccgacaactccgattgggtaacggtagttcgccgcttcaacgtccgttgcgatggaagcaagtgagtcacccatcatcagggaaggtgctccagcggcgaactctacgttttcaatcccgcgtcccacttcacctaaagcttctttcgtgttttttccgttttcaatggtaattagatgagcaagttcttctttatgctgagacagcagctgctggaagttaaatagaattctggcacggcgcggaaccgccacctttgaccatgttttaaatgcttcagcagccgtttgcgctgcgtaatcaatatcctcttgtgtagaaatcggcacttggcatagtacttctttcgtcgccggattgacgacatcttcatattgatctgttttgctttcaacccattcaccgttgatgtagttttttaattttctgatttctgccattcttattgcctccttcattagtaaacacatacacttgtatggatggttccggatagattcatatcaatatccacttttcagcaagccaagaattaaacgctttcaaaaaaaccaaaaaaataaatggcggatgcatatttacatacaagcaaccatttcatgcacaacaggttactttttggtcatttcttggttatattctaatcgcataatacccataagtcaatcataaacactaaattttttcattatttttattatattaatcttttaatcaagtaagagaggtaagagaagcccgccgaatcttgcaaaagatatacaccgatgttatcattttttaagcaactattgattaacttttggtttttattatatatttatgttacgtaaagattcaagaaggagtttttaatatgaaactgatgcggattcaggaaatggaggagtacattttatcgcatggcactgtttccttagatgagctgtgccaggtgttcaatgtctccaaaaacacagtcagacgtgatatcaacaagcttacagaaaagggtgcgattgaaaaagtatacggcggcgtaacatctattgaaaaaaccgcattagttccttttgaaaatcgcaccattcaacaccaggatgaaaaaacaaaaatcgcccattatgcttcccgatttattgaagatcacgatttggtcttcattgattcaggaacgacgacaaagtctattcttgatacgcttgatccagccaaaaatgtcaccatcttaaccaacagtttagacattatcaatgcggcgtcagctttgaagaatatcaacttaatcattatcggaaacaactataagagaaaaacccgctcctttgtcggcatggacgacccggctatgcttgataagtacaatatcaacaaagcctttatgtccgctaccggaacgacgctgacacacggattgaccaactcggatctgctggagtatgaaattaaaaagaggatttcggaaaaagcaaaagaagtgtatctattggctgaccattctaaattcggaaaatcaacgcttctgacatatgcgccgtttgacaggctgcattgcattgtgacctctcagccattagacgacgagtacacgcagtactgcaatgagcatcaaatcggcattcatctggcctaacgtttacaatagtgttgagagtctatcatccattttattctaggaggcagatcatgaaaaaagcgaagctcggaaaatcagacttgcaggtattccctatcggattaggaacaaatgctgtcggaggacataacctctacccgaacctaaatgaagaaaccggaaaagaattggtgcgcgaggcgatccgtaatggcgtgacaatgttagacaccgcttacatttacgggatcggccgttccgaagaattaattggtgaagtgctgcgtgaattcaaccgtgaagatgttgtcatcgcgacaaaagccgctcacagaaaacaaggcaatgactttgtctttgataattcaccagattttcttaaaaaatcagttgatgaaagcctgaagcgcttgaataccgattatatcgatttgttctacattcacttccctgacgaacatacgcctaaggatgaagccgttaacgcgctgaatgagatgaagaaagccggaaaaatccgttccatcggtgtatccaacttctctttagagcaattgaaagaagcaaacaaagacggtttggtagatgtattgcaaggcgaatacaacctgttaaaccgtgaagcggaaaaaacattcttcccgtatacgaaggagcataatatttcatttatcccttacttcccgctcgtatcaggtttattggcaggaaagtatacagaagatacaacgttcccagaaggcgacctgcgaaacgaacaggaacacttcaagggtgagcgtttcaaagaaaatatcagaaaggtcaacaagcttgcgccgattgccgaaaaacacaacgtggatatccctcacatcgtattggcctggtatttagcaagaccggaaattgatattttaatcccgggagcaaaacgtgccgatcagctgattgataacatcaaaacagccgacgtgacgctttctcaagaggatatttcatttattgataagctgttcgcataagaagaaagcagccttctccaatggagaaggctgtttttttgtgcgataaattcctaaataactgattttgaagcaaaaccttacaaaatgagccataaatccgataaaataaaggtagtttatctcagaaagaaagtgattgagaaagcaaaagtatgaaacgttcatatcatccagctcatatgaaataaagctgacccagcttcttttatttgctggtcagaatagcggaccgtttcgatggtctatggaggaaacagaatgaaacttaaatatgtaaaagccttagttgcagtaaccgttgctttaggtgtactgctgccatcaacgatttctcatgcaaagagctttagcggccgctcatcatctagttacagcagccgaagttcaagctcgtcatacagcggaagctataaatcaagcccgaaatcaagctacagctcaggatcaagctcttctagcaaaaaatccaagacgtctgacgattcatcatcatcgatttcgcttaaaaagaagccttcggaaaaggcaagttcctcaagctctaaaaaatcgtcaggcaccttttccggcgctacatcaaaagtaaccggaaagacatacagcggaaaaacgtctaaagcctatgttggcggacgatatgtttcagtcaatcattactatcacgcaggtttcgcgccatcaggatggtttggatattatagcggatttacaatgggtatgttcatgatcagcatgatgcacccatggggttacacctatcatccagtcggaggccccggttatgtttcttatggcgcttcacccattgcctggatcgttgatatcatcgctttgattattattttaatcattgtcatcgcattgattcgcgcatttaaagcaccgaagacgtacagaaggagattttaggcaatgagattaatattaaatgagcaagaaattgtagacggaatttgcgtgtatatttccaatgaagaagatatctaccctgaagacgttgaagtaaaggagctatcttataacaagcgtacagggttcttcgctgaagccacatttggcctgcaccacaagcagcttatgtcagatgacatttcagaaggcattattcagttcttagaggaataccacaacttcaatccggacgttaccgtcgttgaattgcaatttgataagaaaaaaggcttctccgccttggttttcgtcaacgaagcagaagaataaaaatgtcttaatcaaaccttactccgcgcgggtaaggtttttttaatggtttctctgagcataaagttatttcgtttttcctaaactcagcggatctgtgatcatctcttttggctttaacgtttccgttttttcaaaacaaatgtttcaaatgagataggaaatgggtactaatctattaactttgttacacattttagatactcattggctcaacaactgaggaggagacatttgtgaagaaagacacaaggaaatatatgatctactttttcggcgctttagggggactgctatatggttacgatacaggcgttatctcaggagcactcctgtttatcaataacgatattcctttaacgacattgacagaaggattggttgtcagcatgctgctccttggcgcgattttcggttctgccttgagcggcacatgctcagaccgctggggcaggagaaaggttgtatttgtcctttccatcatttttattatcggtgcgctcgcttgcgcgttttctcaaacaatcggcatgctgattgcatctagggtgattctcggattggccgtcggcggttcaacggcgcttgtgcccgtgtatctttccgaaatggcaccgacgaaaattcgcgggacactcggcacaatgaacaacttaatgattgtcaccgggattttgctcgcctatatcgttaactatctgttcacaccgtttgaagcgtggcgctggatggtcggtctggccgcagtgcctgccgtgcttttattaatcggcatcgcgttcatgccagaatcgccaagatggctcgtgaagcgcggccgtgaagaagaagcgagacgaatcatgaacatcactcatgatccaaaagacatcgaaatggaattggcagagatgaagcaaggagaagcagagaaaaaagaaacgacactcagcgtcctaaaagccaaatggattcgccccatgcttctgattggcgtcggccttgccattttccagcaggcggtcggcattaacacggtcatctactacgcgccaaccatttttacgaaggccggtcttggcacatcagcttcggcgctcggcacaatgggaatcggcgtccttaacgtcatcatgtgtatcactgccatgatcttaattgaccgtgtcggacgcaaaaaacttctgatctggggaagtgtcggcatcacactgagccttgctgctttatcaggcgtgctcctgacactggggctttccgcatcaacagcgtggatgacagtagtctttctcggcgtctatatcgtcttttaccaggcgacatggggtccggtagtgtgggtgctcatgcctgagctcttcccgtccaaagcgcgcggtgccgcgacagggttcacgactttggtgttatcggcagccaacctgatcgtgtcgctcgtcttcccgctgatgctaagcgcaatgggaatcgcatgggtctttatggttttctcagtcatttgtcttctctcatttttcttcgctttctacatggtgccggaaaccaaagggcgaagcttggaggaaattgaagcaagcctgaaaaaccggtttaaaaagaagaaaagcacccaaaaccaaatgctgaatgagcgtacattataaaaaaaggaatcgtctccttatgggacgattcctttttctgtttacaccatgaccttgcaaatattgttcgtaaattccacggggtcctgaatcggcaggccttcgatgagaagcgcctgattgtacagaaggtttgtgtacaggctcagcttctctttatcttgttcaaacgcgtcctgcagcgtttggaatacctcgtgatttgggttgatttccagcactttttccgccttcacattttggctgtcaggcatcgcgtttaagattttttccatctcaattgtcacttcgccgtcagcagcaaggcagactggatgtgatttaagccgttttgagattctgacgtttttcactttgtctgacagaatgtttttcatttcctcaaacagatccttatacttgctttcctcttcctcggactgcttttgatcctcatccgtgtctatgccaaggtctccgcttgatacggacttgaattctttttcctgataagaagccagcattttaattgcaaactcatcgatgtcctcagtaaagtagaggatttcatagcctttgtccgccaccatttccgtttgcggcagtttctcaatgcggtcgtaagaatcaccggtcgcgtaataaatgtatttctgctcctctggcattctggaaacatactcgtctaagctgaccagttttttctcttttgaagagtagaataataggagatccttcaattgatccttattcgcgccaaaatcattgtacacgccgaatttcagctgtctgccgaacgacttgtagaacgtctcgtatttctcgcagtcttttttcaacaggctttgcagctcgcttttgattttcttgctgatgtttttcgcgatcagcttcagctggcggtcatgctgcagcatttctctggaaatattcagcgatagatcctcagaatcgaccatgcccttcacaaagctgaagtggtccggtagcaggtctgcgcacttattcatgatcagcacgccattggaatacagctccaagcctttctcatattccttggaatagtagtcaaacggcatgttttcagggacgaatagaatcgcgttgtagcgaacggctccatccacactgatatgaacgtgtgtcagcggtttatcaaacccgtaatgcttttcagcatagaatttttcataatcctcatctgtcagctcgcttttgttttttctccagatcggcaccatgctgttgaccgtctgctcttcctgcacctcttcaaattcattttcgctgccttccttcggcttattaatggttgtatccattttgatcgggtagcgaatgaagtcggagtacttcttgatgatcgcttttaaacgatattcctctaaaaactcgtcatagctgtcatcctctgtgttctctttgattttcaggataatgtctgtaccgacagaatccttttcacacggctcaatcgtatagccgtctgcacccgcagactcccatttataagcctcttcgctgccaagcgctttactgatgactgtcacgacatcggcaaccataaatgccgcgtaaaaaccgacaccgaactgcccgataatgtcatgtccgtctttcagctcgttttcctttttaaacgcgagggaaccgctttttgcaattgttccaagatgctgttcaagctcatcctttgtcattccgatccccgtatcagagatggataatgttctcgcatctttgtcagctgcgacctttatgtagtaactgtctttatcaaacgtaagcgcatcgtccgtaagcgctttgtaatagattttgtcaatcgcatcactcgaattggagattaactcgcgcaggaaaatttctttttgggtataaatggagttaatcatcatatccagcaagcgtttagactctgctttaaactcttttttcgccactcttgatcgctcctttaccattatgtaaacccttttcagcatctatttatcacataagatgacaattgtcaattagattgatagatgcatatatatgtaaatttaacattagttggattttttttcactctttttctcactcattctcataaaaaagagaggcttcatcatcctctctttttttctgtgtcattccagcggccaaactcccgcttcatccatatatgcaccgggtagaaaaacaaaccgaacggtatcaaaaacaaaagattatgccatgaagcattcagaaatgcgcttgcagtcaccggaaacgtaatctcttgcaataaaaaagagatgacagtcagcacaacaaatgcagatggaatggtcacgatgcaataaaacttgagctccttcttatgctgtaccttcaaacatacaaacctcccaacaatttctaattcatcttaacatatgctggcctttcttttctcgcatgtttatcactgcacatagcgggaagacaaatagaaaaaggaggtctcgtatcatgggaagactcgaaaacaaaacagcagtgatcacaggcgccgcgacaggcattgggcaagcgacggcagaggtttttgccaatgaaggcgcgcgtgtgatcatcggagatatcaataaagatcaaatggaagaaacagttgacgcaatcagaaaaaacggaggacaggccgaatcctttcacctcgatgtgtcagatgaaaacagtgtgaaagcatttgctgatcaaatcaaggatgcatgcggaacgattgatattctgtttaataatgccggcgttgatcaggaaggcggaaaggtgcacgaatatccggttgacctgtttgaccgcattatcgccgtcgacctgcgcggcacgttcctttgcagcaaatatctgattccgcttatgctcgaaaaaggaggctccatcatcaacacctcctccatgtcaggccgtgccgcggaccttgaccgctccggctacaacgcagcaaaaggcggcatcaccaacctgacaaaggcgatggcgatcgactacgcacggaacggcatccgcgtcaattccatttcaccgggtacgatcgaaaccccgctgattgacaaattagcaggcaccaaagaacaggaaatgggtgaaaaattccgcgaagccaacaaatgggtcacgccgctcggccgcctcggccagccgaaggaaatggcgacagtggccctgttcctcgcgtcagacgacagctcatacgtcacaggagaggacatcaccgcagacggcggcatcatggcatacacatggccagggaaaatgctgattgatgagaaatggaagaaagaaacgaaataagagaggggatgtccctctctttttgtctttcaaagcaatacaaccttatactttttcacatccaaaaactgcaaaaattccctcgccagcacttcaggcggatgcgcctttccttcatccagccgatacaaaagcaacccaataatcattgcggatacataatgggcataaagctttttctctgcgtgaatatcagtttgctgatgcagataaaacgattccagcgctttgaacatatcaggtatcacatgaggaacaccccattcccgattgaaaaaatggacaatgggcatgtttgacaaagcagaaagcagactggcgagcgccttctccgcttcctttaaggaaaattcattcgggctggaggcaatcgtcaggtgatcaatgatctccgcacatgatcgctgtatcatggtttggagcaattcctccttattggcatagtgatcataaaaggttgcacggcggatattgcttttccgggtaatatccgaaatcgtgatggctgcgtagtcttttttctccgccagcaagtccaaaaatgccttctggagcgcctctctcgttcgaaccacacgcctgtcgatttgcttgtccttctctcgctctcctggcacagcttgtccaaacagccaataaaatctcttttgagaaacaagctcccataccttttggctgatagcttccggagtcgcggccgcatcctcattcagccaatacaggataatcgcgtacgtgtacaaggcccggtaatgtccgtaaatttcccgttcgatcggcgtcaaattcacatggaccggagtcagcagaacatcctgctgaaacacatccctaaaaaaacgatggaaatgccctctgttcatcatcacagaaaaaaaggatcgatgctcatgaacaaaggacagcgtcggatgcaccgtttgccgttttttgttcaaatgaagggtatccatatgactgaaggcgtcaaaaagcgctttgcccagcccttccttcatgtcttcgattaaatcctcaatgattgaaaacttatcctcataataaaggtagagcgatccgcggctcactttggccttctcagcgatttctttcattgtgatgtgttgaatatctctatctttcaataaggccagcaacgcctctttcacttgagcttcggcagattccggcacaaaagacacccccaatcattagacagttcttcgatatatgtacggtaacgtatagatggttcaccgttgtctttcttacagaaaaggtaccaccttataataggtccgagaaaagaagaaagcaaatgagggggattttacaatggaacagcaagtaaaggacgacatccagcgtgtctttcagcttcagaaaaaacagcaaaaagccttgcgcgcttcaacagcggaacagcggagagaaaagcttcaacgctttttagattccgtcatcgaacatgaagaagaaatcatcgaagcgatccgcaaagacgtccgcaaaccatatcacgaggtcaaaaaagcggaaatcgaaggaacaaaaaaagcgatcagagataatatgaataacctggaacaatggatggcgcctaaagaagtcggttcatcgttaagccctgacgcaaacggaattcttatgtacgagcctaaaggcgtcacactcatcctcggcccgtggaactatccgtttatgctgacgatggcgccgcttgccgcttctctcgcagccggaaacagcgcgattgtgaagctgtccgatttcacgatgaacacgagcaacattgccgctaaagtaataagagacgcttttgatgaaaaagaagtcgcgatttttgaaggagaggttgaggtggcaaccgaactacttgatcagccgttcgaccatattttcttcactggaagcacaaatgtcgggaaaattgtcatgacagcggctgccaaacacttggcatctgtcacacttgagcttggcggcaagagcccgacgatcattgacagtgaatacgatctgatggacgcagcgaaaaagatcgccgtcgggaaattcgtaaacgccggccaaacctgcatcgcacctgattacctgttcattaaaaaagacgttcaggacaggttcgcggggattttacaaacagtcgtcaacgctggatttatggaggatgatcataccccagaccgcagcaaatttacgcagatcgtcaatgaccgcaacttcaaccgggtcaaagatctgttcgacgatgccatcgaaagaggggcggaagtggtgttcggcggcgtattcgatgccagcgaccgcacgatctcgccaaccgttttgaaaaacgtcacgcctgacatgaaaatcatgcaggaggaaatcttcgcaccgatcctgccaatgatgaactatgaagacatcgacgaggtcatcgattacgtaaatgaccgcgataaaccgcttgcactttatgtgttcagcaaaaaccaagacctgattgacaacgtccttcagcacacgacatcaggaaatgccgccatcaatgatgtcgtcgtccatttcagtgacgtcaacctgccattcggcggcgtaaacacaagcggaatcggctcctatcatggggtatacggattcaaagagttttctcatgagaagggtgtatttattcaagcctccaaataatcgtaacgaagagaatctgcatcatcttgcaggttctttttttatctttatatcacctaaataaagagattaaaagtgataaaataccatttttactacgagaccaaaccctgcagcctctaacgtataatatcccagaaaacttcaaaggagtaaaatgatacatggaaaaaccagcaggattttggattcgggcagccgcctctattattgatgtatttattatagctatattctctttcattatgattttcattaacaccttcattgtgttgccactcattgatgcggcaggtacacacatgtcagaagcccaatatgagtttttcatgttgatcattggcacaatccctgttttggccatcatatttattttcgctattctttactatagcttgctgacttcttcaaacatgcaagcagcattgggaaaaaaactcatgggcatcatcgttgtcaatcagcatggtgagcgtatttctttttggcacagcttcggccgtttcttcgcttacacattatctaagatcttatatatcggttttatcatggcggcctttccctctaaactggcattacatgattatatttgcgggacaaaggttgtctataaaaataaatatcttgattgatcaaaaaaacaggctgccaagttaacctcgccagcctgttttactatttcccaaaagccatcagcttcgtataacttccaatataaagcgttccgtcctcagcgagctgaggagaagacacgacgttgctgtcggtttgatagctccataattcattgccgtttgcgtctgccgcataaaccttcatatcatctgacccgaaatacaccgttcccgtcgcgtcaatcagcggcgccgttctgacagggccgtctgtgtagaatgaccagttcatatccccgtttttgctgatggaaaacagctcgccgcttcctgagccgatgtagatattgccattatgatcaatcgcaggagatgagctggagaacccgtttagcggaatgtccatttcaaactgcctgttgatgtataagcatacagctgtccatcttggttgccggcataaatgtttccgtccttatcaatcaccggatatcctttaaacgcatttgacgtcgttctggaccatttcacctgtccggttccggagttgatcgcataaaacacgtaattatatgtgccgacatacacggtgccgtttttggcaagcaccggcacagagctgacgacaccatttgttttcaacttccagcgctctgtccaggttgattttgacgtcggtttgatcgcgtgaacataattatcaagtgttgagaaatacaacgtcccgtctgaaccgatcaccgtttcagagcttggcccgccgcttaacggaaccgttgttaaaatttctcccgtttctttgtcaataaaataaatctttttgtcataggatgccaaatagataacgccgttggtcccaagtacaggagattgcgtatatgtttttccaagattgccagtcacccatttgactgagccgtctggattaaaggctttcatttccccgtctctggaatgaagatatactgtgccgtctccgtcaatcacagcccccgctccattttgcggagtcgttctgatgtcgttttgccatttcagcgtcccgtctgtatttccggcgaaccggctttcgcgtgaccagttaaacatggcaggcgccatcgcttgtacatcatatcttcctggcaaaaagccagatgctccattattttgagaaaacaccgtttccgccgcataagcagctgtcggctgaagcactatggcagtgggcacatcagaaacagcgccggccgaaacagccgccgccaccgcagctcccgcaatcaaagctttcatacgaaatgacttgaccatcattgagacccccattatatgtaacttctaatttgtgaccatcataacatattcatccattttataaatctatttcacaaaaccatcacaaactagaaaactatgtaagtgtatgcgcagacgttttttcaacacccggccgaaatgcagacacaaaccaaatgacgttgacagcagccgcagcgagactaattccgaaaacaaagatcacctcagaaagcagatggtcactaaagaaactaaacatcaagataaaaccggccgaagacaaatgaatcaaaagcccgaagccgcaaagcaccgccatgacatacctcattgcatcgactccgagcatataaacgagaaatggaatgaaatacaatacaaggatcataccgacagctgaccacatgccaactgaattaaactgattggccgccgctcccgttccggccagcggcgaaagtgaagccgccacgatcacagcacaaaaaagaaacgcagaaatggctgtcatgatcgccacgctgttttttctagacatcaaactcctccttagatagaaatattaaccttttcattataagagagctgtgtagaaaattcattatttattaaaaaattccagaatgcatacacaaatgctatgcttctttctagtatatttatatagtaaaaaacaaaggataaaagactcatttttctgtaatatcaggattttatcaccataccatattgcatgtacttgtttttcaaagtatactattccagattaattcagaggagagagaaaaatacatggaaaaaccagcaggattttggattcttttttagcttattttattgatggcattattgtatctgttcctagttatattattctatttgtgatcaattctgtttttgtagctggggctgtggcaacaaacccttacatgacggaagaagagtatttagtgaaatacatgacgcttgcatttttgcctactatgctggtcatgatcgtcatcagcgtattatattacgggctgctcacagcttctaaaatgcaaggcacacttggcaaaaaaattcttggcctgaaagtggtcaatgaacaaggcgaacgggtttctgtcggacagggaattggccgttactttgcctatatcttatctggaatcatcttttatatcgggtttatcatgatcgcctttggagagaaaaaaggcctgcatgacatcatttgcaaaacacgtgtcgtgtataaataatagaaaaaagtctagacgccaataggcgtctagacttttgttttctttacaataggctgccacgacagatacgtagcgcttctccacagccactcaaacggccccatccgaaagacacgaagccaaaggtggctgaagaccatttgaacggcacaaacagcaattgtaatgagcacgcccgcagcagggtacacttttccatacaggcccaagccgtaatgataaaaaatccaagtacacacaatagactgcatcaaataattggtaaatgccatcctcccaacaacggagaatgattgcaacactgttctcacttttgttttatgataaagatagacaaccgttgtaacatagaaaaacatgaggaaaggcgcgccaatcagcagaaatagttccttttccgttacactgtacagcacatgggcgccgatgccgatgacaagcccagccatccataatcgttttaatcctttgcgatgcttttccggttcatgcaaataccgtgattttgctgccgcagctcccagcaaaaacatgctgaaatatggaatggatgcaaagaaaaagttgagcggattatacgtaagcatgccattcgaagacatgtaaacaagacgatcatggatccgttgttctgcaatgtccctcaggctgccgcttccataaacatgaatcgcttgttttgcctgctgtgttaccgcttgtacccattcctgtccgtttgattgatcaaaacttgtcaacatgaacggaatggaaaacagaagatacaaagagaccgcccatatcagcagtgttttcggctttgcttttcgaaacaagagcaggacaaaaccgagcagggcatattctgttaaaatatccccgtcccatatcaaaaaggcatgaatcgttccaaacaagagaagcgccattaaccttctcacatataacggaacaaaccgtttccctttgttttctgctctctccatcatgacaaccatgccaaatccaaataaaaaggaaaacaataaaatacattttgtttgaatgaagaatttcagtatgtctgcggcggcaaaatcagcttcagaccacttatccatgaaaaaattctcttttccaagcatagacaaatacatatccggataactgaaatgtgccagattgacaaataagatgccgaaaatcgccattcctctcagcacatcaagcacaccgatccgctcatttgttaaagtcggctgtaatgaagacatagccatcacgctccttttttctgtaccttaagggtatgaaaaaatgaagcgcggaaacatcgatttaggtgtcaggccggcatgaaaaccttacaatcttgtcatctttatggtttcatcacctttaaatctaatgcttcgatattctgcaaaacgcgatcaaagcgcaaagcctgaggctcacatgggaagatgtggccttcatacgggtcgcctaacgtccggaaaaacggttcaaataaaccaggaaccaatacgcccaccatctttgtatagtaagaatcaaggcgataggagtgaacggtatttgcagggacatgcaggaaatctcccggattcagctgaatttcctggccatctgcccacatcgtcatctgaccttcaaggcaataaaatgtttctgtatgatgttcatggtagtgatcaacgattcggtcacctttagggccttcagaggatacgacgataaactggccatctgtatttttttgtgcagccacaatgcggtgaagctgatctccagtcaacaggcgatctccttctccagattcaagaacgtatggaaccgctccatctggcagctctgtaagttccgctaattgggccgaacatgcaggctttccttcatctagaaatacaatgtccgctacagcggctgcttctgcaaatcgctcgtttgagacttcttcgcttgcgtacggcggatgttcagcgtgatcatacggattcccaataacggaatacaagtgcgctacgtttcctttcatcgtgtaagataccagtcttgttctgtggctctgcatccggtagctgtgcggtgttcccgccggaatgttggcataatcacctgatattaataaatagcgttcaccatcaagtgtcagttccagtttcccgtccaaaacgagaattccttcatgtgtgtccttgtggacgtgaagcggaaaggcatctccttttcccccggaaagaagcacgatctcaaacaaatcacctgtgctcctcccattcgccatcaccgtggcaacctgtctgccgaacagatagcgctcgccttctccgctccggagcaaataaggcattttttctttaggcaatgaatgtgtacataatgttttcatattatcgcttcctccaatttagaccagtctatatattatcatttatttgtctagaccgttctatataattgtaggagaaaggataacaaaatgctaccctttttttctcaccagcactggtatttgttcggcaatgagaagaagaggcgttttgtctttattcgttaacgaaagcatgatgccgccctcaatcatcgaattaatcagcgttccaagctgatttgcttcttcttctgcaaatccgttctccattaattttctggcaaaaaccgcttcccagcttttaaacaccttcatgcaaaccgtccgcagcggttcactgattaacgctgtctcactcgccagcaaaccgactggaatacctttaatgctttctgtgttatcaaattggctggctgtttttttgataaaaagctgaatcgcttcaacaggatcagaggattcatccatgcttttctgtatcagatgttcaacgatcttacccgtatatgtaaccgcttcaattgctagttcttctttgcccttcggaaaaaagtgataaagcgatcccttaggagcaccgctttcttttacaatctggttcaaacctgtcgcgtgatatccttgcagctggaacagacgtgacgccgtgtgaaggattttttcacgtgaatctcctctgctagtcattaaaacattccctcctaggtatggtagagcgacttatataatataaaaaagaaccctgtgattgtcaaaaggggtaagacccttccggatggggtaatgtacaaaaacagcgtctaggagggatctctcaatgacaatcgatcattcagtcacgaatacagaacagcttgaacgacaaaaccccgccataaaaacaaagctcaaactgaaaaagcttaaggatcaggtgatcgtcattaccggcgcttcaagcggaatcggacttgtcacggcacgaatggcagctgaaaaaggcgcaaaggtcgtggcagcagcgcgaaatgaagacgcgctgaaggagctcactgatgaacttaaggaaaaagggcacgacgccatatgggtaaaggctgatgtcggaaaagaagaggacgtcaaccgcatcgcagaaaccgcgatcagcacattcggccgctttgacacatgggtcaacaatgcggccgtctcgactttcggacatgccatggacgtcaccgtcgaagacatgaagcggatgtttgacacaaatttctggggacctgtttacggaacaagagcggctgtcaaacactacaccggcagaggtgtgccgggcgcactcattaatgtaggaagcctgttcggagacaggggaacggtcattcaatccacatatgcatctgccaaatttgcgcttcacggctggacggaaagcatccgaatggagctcgaaaaggaacaggcgcccgtctcggtaacgctcatccacccgggcagaattgacacaccttataacgagcatgcgcacagctacctcgacaaacagccggctcattaccgctccatgatctatccaccggaagcagtcgccgaagctatcctgtttgccgccgaacaccctaagcgcgacatgtacatcggctcacaggccaaagccatcgccatgctgggcgcgcttttccctcgtctgaccgacagactgatggaaaaaatcatgtatcacagccagcatgccgaaaaaccgtccaaaccgcgagaagaaagcgctctttatgatgcgggctgcggtatgcatgacagaggcacaaataaaggatggatgaggtcaagaagctactacacgaaagcgacgaagcgccccattgtatctgcggctgttgttgcaggactagtggcttgggctgccgccaaacgatgcagataatctctgaccataagaaaaacccatgctgttccagcgaaccatgggtttttcagctgttaatcgataaaagccttgttcatacgctgcagcagctcgccgaacatctctttttcctgtgttgaccattctttcagcatctgttcataacgttcaaggcgcttttgctgatcggcttttaatagttgtttgccgagttttgtaatggtaaacaggctgactctcccatcagacgggtctgagaaacgatagatgagctcctttgcctctaatgcagctgcttgtcttgaaagagtagaaatatcaagcttaaacgattcagccaattccttaacacgagcaggcccaaactcatccaattgtctcagtaataagtacgaagatctctccaaattccctgttcttttctccgattgatccagataaacagctctcctgataaaagtcgtcagctcatattcaattaattcaactggattttgattttgcaatcgatttcgctccctattccaatctccggcattgacaacatcatatatacttgtataatacaaatgtacattaactgaataaatacaagtcgttatatgaataaatcaatcattatacttgtatagtacaatcatataaaaagaaagtaaagcgattcctcagaaccatcctagaagcaagcaccagaaaggaggaagctgttctgattggagagcagcacttgatgtgaaagtcatacgaattatcttgcaagtgttgatattatatgtattttttatgatcggggaagccattcagcatctgtttcatttacccgtatcaggaagcatcgttggattggtattgcttctgatctgcttgggcctccgtattgttcccgtctccatcattgaagacggagcagggtttttattatccttccttccattgttgttcatcccggcaatgacaggagtgataaactatccgtctctcatttcattcaatggtctgatgctgctgattacagtcgttctgagcaccatcgtcacgatcattgcggctggattcgccagccagctattagagaaaaaagcaaaaaaacgaaaggagaaagagaaatgcagcaagcatgtatcgcgatcattataattcttttaacagttgccgcttatttagcgatggtcaaactctataagcgattcccgcttccatttcttatccctgttctgacaacgacaattttgattgtagcggctttgatgatgtttcatgtttcctatgaaggctatatgatcggggggaaatggatcaattctttgcttgggccggctgtcgtggcactggcctatccgctttataaacaatggcatatcattgtcaaacattgtgttcccattctaggcggcgtcctggtcggattatgcatgggaatgatcagcgggctgatcttcgcagaagcattcgggattgatcatgatctcttattatccattctgccaaagtcgatcacaacccctgtcgctattcagatcgccgccggtcttggcggcgtcccttccatgacagtcgtatttgtcatgattgcgggcttttcaggcgtcatcctcgggcctcttttcctaaaatggcttcgcatacgcagttcccttggacaaggcattgcattaggcagcgcctcccatgcactgggtacctccaaagcgttggaatatggggaattggccgtatccatgagttccgtctccatgacgctttgtgcggtgctcggctcattcttcggcccgctcgtcgtctggctgtttcatatttaacaaagaaagactgccccggggagggcagtctttttcgtttaagaagcaaaaaaatcaatcagcggctgaaagtccttagataaatcaacgtcattcggctctgcttgaagcaggcggtcaatcatgcgctccagctcctcaacatcattcttatctgtatattcaatgaagtttaagctttcaagccaatcccggtatgaatgtttggctttgccatagctgtttccaaagacaaggcaaggtgttttggtgataatcgagaaaatcatcgcgtgaaggcggtcggtaatcaccaatttactggagccgatgcggtccagcatctccataaaatgcttttcacgatcggcgtagtcgatggtgtcgaccgtatccagcaccgtatcggtacgctctgtgtaagttgttttttctgcccatttcttcatctgtgaaataaaatcttcgtcagtcactttctccttatccgctcttaaaataaagagaacgccgtcccgctcgagctctcgcggcacaatatccaaggaaagcaccatgtccggtgtaaagatcacattggagttgaaggtctctttcacaacatccagtgtttgcgtctcacgcgcagcaatcgttaagtttgtattttgatggtacgcatcctgtgtttttttcttttccttctgtccttcctctgtatcctcaaaataaacggattgtggcagagaaattgatttgtagtctttaaacgccgaaaagacctttcttctgtcttcctcaatatcgagataaaggtttcctaaattccctccgcctgtaaagcagacaatatcgtcttcacgaatgatctccttcaccagttcaatgccctcatccgtcgcataatccataatctcaatgtattcataatacggaaaatgatttttgataaatttctcttccgcatacgcaatcgcttggtcgccaatgtttgtgtagctaggggaaccaaacaaaaatacttttcgtttatcatttaacagagcttccggctccacatttggcgcaatgccttttactagttttttgcctttgatttcttgtacagtcatatctgcgtcctccttctgggatgaattcctcattgtgtgttaactgtctctacccaaaaagaaggatggctatgcattggcatgtgcatcggctatatcagaaacatcgttttcgccaatttgatagacgctgcaatgtcccgcgccgttctttccatatattccgcggcatgttcaaacgcgtcttctagcggcacggctccggggacgatgctgaaaagcgcatcgattccgtgttgatagacggcattactgtctcgggaaattgatcccgcaatgccgataacgggcacatcgtatgatttagcggccttggccaccccgatcggtgtttttccatgaaccgtttggctgtcgattcgtccctcgccggtaatcacaaggtctgcatcctgaacgatactttcaaaatcaaccgcttcaaggacaatatcaatgcctcttttcaggtcagcctgaagataagttagcaggctccatccaagaccgcccgctgcaccggcgccctctgtatctcggaaggttgatccgagcgctttttctgccatatcagcgaaatggcttacgttctggtctagtacatctatcatttcggccgtcgcgcctttttgcggcccgaaaacagccgtagcaccctttggtcctgttaacggattgtccacgtcacaggcaacttccagtttgacattccgcagtctggaatcaagcccgctcacatctattgatgcaagctgagataacgcgccgccccccgggccaatctcgcggcctgagttatcaagaagccttccgcccaatgcctgaatcatcccggctcccccgtcgttcgtggcgcttccgccgattccgatgatcaaacgctccgctcctgcatcaagagctgccccgattaattctcccgttccccttgttgtagtgatgagcggatttcgcttatctacaggcaccagatgcagccctgaagcagcagccatttcaatcacagctgttctcccatctcccatcatggcaaagaaagctctcaccggttccccagcggccctgtgacaacttgctctatgatccttccgttggtcgcatcgactagagattgaacggttccctcgccgccatccgccaccggcaattttctgtaatcagcacccggaaagaccgatttgaaacctctttctatcgcttcggctgcctccagagctgataagctttccttaaaagaatcaggtgcaatgatgattttcatccaaatcgcctctttcaaaacatgattcacttatgctagttatctccaatgtaccatattccatttagaaataaataccataatgattgggaaaaattttattaaaaattagaaatgaaagtgtttgcataaaagaaatattcacgttatcatacttgtatacaagtatacttcttgagtgaggaaggtgagtgtatgctagactccaaagacctgttgtatcccgcaaaatggctctcaaaagcgtcaaccggagttcgtgtcgcatacgagctgagaatgcggatcgtttcaggcctgattgaaagcggtaccattttatcagaaaatacaatcgccgccgagttttcagtaagccgttcgccggttcgcgaagcgctaaaaatactcgcatccgaaaaaatcatccgcttagaacgaatgggagcggtcgtaattggtttaactgagaagaaaatcgcggaaatttatgatgtgcggttactattagaaacatttgtctttgaacggcttgtcaaaatagacattgagcctttagttaaggatctcagcaaaattcttgaaatgatgaaagtctcaatcaaatatgaggatgctgacgaattttcatttcaagatgtgctgttccatgaaacgattatccgagcgattgatcattcatacattcagatgatctggaacaatctaaaacccgtcatggaaagctttattcttttatcgatgcgggtacggttaaaggaaaagtatgaagacttcacaaggattttagataaccacgagctttatattcaagccatcaaaacaaaggatagggcgctgatgattcagtctcttcaccaaaactttgatgatgtgcaggataaggtagaagacctatggctctcacaacaaatgctggcaaaaggagctgaatacagcaatgactagttatatgttaggaatcgatatcggcacgacaagcacaaaagctgtgctgttcagtgaaaacggggatgtggtacagaaagaaagcatcggctacccgctctatacaccggacatctcaacagcagaacaaaacccggaagagatttttcaggcagtcatccatacaacagcgaaaattacaaaacagcatcccgaaaaacagatctctttcatttcgttcagcagcgccatgcacagcgtcattgcaatcgacgaaaatgacaagccgctgacgccatgcatcacatgggccgacaaccgaagtgaaggctgggcgcataggatcaaagaggaattgaatggacatgaggtgtacaaacggacgggaacaccgattcatccgatggcaccgttaagtaaaattgcctggatcacgaatgaaagaaaagaaatcgcttctaaggcaaaaaaatatatcggcatcaaagaatacatttttaaacagctgttcaatgagtatgtcatcgattactcattggcatcagcgacaggcatgatgaacctgaaaggcttggattgggacgaagaggcactgcgcatcgcaggcatcacgccggatcacttatccaaactcgtgccgacaacccagatctttcagcactgcagcccggaaatagcgatccaaatgggaatcgatccggaaacgccttttgtcatcggggccagcgacggcgtgctgtccaacctcggcgtcaacgccattaaaaagggagaaatcgccgtcaccatcggtacaagcggtgccatccggacgattattgacaagccgcaaaccgatgaaaaagggagaattttttgctatgccttgacggacaagcattgggttattgggggacctgtgaacaatgggggcatcgtccttcgctggatcagagacgagtttgcctcctccgaaatcgaaacagcgacacggctgggcattgatccatatgacgtgctgacgaaaattgcccaacgcgtcagacccggttctgacggtctgctgttccacccatatctcgccggagaacgcgctccgttgtggaatccggatgtacgcggctcattttttggcctgaccatgtcgcataagaaagagcatatgatacgcgcggcattggaaggcgtcatttacaacctgtacacggtgttcttggcgttaactgaatgcatggatggcccggtaacccgcatccaagcgacagggggttttgcaaggtcggaggtttggcgccaaatgatgtcggatatcttcgaatcagaggttgtcgttccggaaagctacgaaagctcatgtctcggcgcctgtattttaggcctgtatgcaacaggaaaaattgactctttcgacgccgtgtccgacatgatcggcagcacatacagacatacgccgatcgaagactcagccaaggaatacagaacattaatgccgattttcatcaatctatcaagattattagaaaatcaatatacacaaattgcagattatcagaggggcttaatcacacacaaatagtacatgacatgaaggggagggcattaccatgccgttaatcatcgttgcacttgggatcttagcattactatttctgattatgggcttaaaattaaacacatttatttccctgctggtcgtatcgttcggcgtggcactggcactcgggatgccgttcgataaggttgtcagctccatcgaagcagggataggggggactcttggccacatcgcgctcatcttcggactcggtgcgatgctgggcaagctgatcgcggattcaggaggcgcacagcgcattgcgatgacgctcgtcaacaaattcggcgagaaaaatattcaatgggccgttgtcattgcctcatttattattgggattgcgttattttttgaagtaggactggttctattaattccgattgtctttgcgatttcaagagaattgaagatttctattttatttctcggaatcccgatggtcgcggcactatccgtcacacacggtttcctgccgccgcacccgggacctacggcgatcgccggtgagtatggcgcaaacattggagaagtgctgctgtacggctttattgttgctgttccgacagtgctcatcgcagggccgttatttacaaagttcgcgaaaaaaatcgttcctgcatcatttgcgaaaaacggcaatattgcatcactcggcacacaaaaaacgtttaaccttgaagaaacacccggctttggaatcagtgtctttactgcaatgctcccgattatcatcatgtcggtcgcgaccattatcgacctgcttcaagaaacaatcgggtttgcagataacggagttttagcttttatcagattgattggaaacgcatcgactgctatgattatttcgttattggtcgcagtctatacaatgggcatcaagcgcaacattccagtcaaaaccgtgatggattcttgttcaactgccatttcacaaatcggcatgatgcttttgatcatcggaggaggcggcgccttcaaacaagtgctgatcaacggcggtgtcggcgattacgtagcagacttattcaaaggaacggcattatcgccaatcattctggcatggctcatcgcggcgatcctgcgcatttctctaggatcagcgactgttgccgcactaagcacaacaggtctggtcatcccgttattgggccattctgatgttaacctggcgttagtcgtgctcgcaacaggcgccggaagtgtcatcgcttcacacgtcaatgatgccggcttctggatgttcaaggaatacttcggattaagcatgaaagaaacattcgccacatggacattgctggaaaccattatttccgttgctggactgggattcattttattgttaagtttagttgtatgaaattaagaaggagctgtaacacatgttcaattcgattggtgtcataggcttaggcgtaatgggaagcaacatcgccttaaacatggcaaataaaggtgaaaacgtcgctgtctataattacaccagagatttaacggaccagcttgtccaaaagctggatggacaatctctcagcccgtattacgagcttgaggactttgttcaatcgttagaaaaaccaagaaaaatctttttgatggtcacagcgggaaaacccgtagattccgtcatccaatcattaaagcctttgcttgaagaaggcgacgtcatcatggacggaggaaactcccactatgaagacacagaaagaagatttgaggagctgaaggaaaaagggatcggctacctgggagtcggcatttccggcggtgaagtcggcgcattaacaggaccttctatcatgccgggcggagatcgcgacgtctatgagaaagccgctcctatcctgacaaaaatcgcagcccaagtcggagatgacccttgctgtgtctatatcggaccaaaaggggcagggcactttacaaaaatggtgcacaacggcattgaatatgccgacatgcagctgattgcagaagcgtatacgtttctaagagaaacgcttcgtctgccgctcgatgaaattgcatctatttttgaaacatggaatcaaggtgagcttaaaagctatttaatagagattacagctgagattttacgcaaaaaagacgaaaaaacagggcagcctctgatcgatgtcattcttgataaaaccggccaaaaagggaccggaaaatggacgagcatgcaggcgattgataacggtatcccgtccacgatcatcacagagtccttgttcgcccgctacttgtcatccttaaaagaagaacggatggcagctcaagacgtattagcaggcccggaagccgaagaaaaacacttggataaagacacctggattgaatacgtcagacaggctctttacatggggaaagtatgcgcctatgcacaaggctttgcccaatataagatgtcatctgagctttacggctggaatctgccgctcaaagacattgccttgattttccgaggcggctgcatcatccgcgctgatttcctaaacgtgatcagcgaagcattcagtgagcagccaaatctggctaacctgctgatcgcgccttatttcacagataagctccatgcctatcaaacaggcctgcgaaaagtcgtttgcgagggtatcagcactggaatctctttcccatgcttaactaccgcgctctcttattacgacggctaccgcacagggcgttccaatgcgaacctcttacaggcacagcgcgattactttggcgctcacacgtacgaacggactgatatggacggcgttttccatacgaattggtttgaataacctgtcatcaaaaacacggtcagttttcaactgaaccgtgtttttttcttctatcccaaacaacagaagacataagttatgttttaaatatcataaacagtgatacaataatagctagaaacaatccccaagatcatcatgtgacagcagcttgctgttccgttctattctgcttttggccattgtcctttgcccttgaccatggtgtcataaaatgttcaaatgccaaaacggcctgtcattctgatttacaaaagtccctgaaaaccttgtctaattgagaatcagcctctcatttgttataaaagaaatgcataaatcctacctgtcacacctttagtaagatgaaaaaaagtaggttatggcttgacaaaaaatatatattaattaataattcatatataattagaattattattgaaagcgaatatgctttctaatacatttttaggaggaatatacattatgtctttaatcggtaaagaagtacttccattcgaagcaaaagcattcaaaaacggtgaattcatcgatgtaacaaacgaagatttgaaaggccaatggagcgtattctgcttctacccagcagatttctctttcgtatgcccaactgagcttgaagatcttcaagaacaatatgctgctcttaaagaattaggtgttgaagtatactctgtttctacagatactcacttcgtacacaaaggctggcatgacagctctgaaaaaatcagcaaaatcacttacgcaatgatcggtgacccatctcaaacgatctctcgcaacttcgatgttcttgacgaagaaactggccttgctgaccgcggaacattcatcatcgatccagacggcgttatccaaactgttgaaatcaatgcaggcggtatcggccgtgacgcaagcaaccttgtaaacaaagtaaaagcagctcaatacgttcgtcaaaacccaggtgaagtttgcccggctaaatgggaagaaggcggcgaaactcttacacctagccttgatctagtaggtaaaatctaaggagtgcattcaattggtacttgatgcaaacatcaaagcacaattaaatcaatatatgcagctaattgagaatgacattgttctcaaagttagcgcaggcgaagatgacacttctaaggacatgctggctctcgttgatgagctggcttccatgtcatcgaaaatttcagttgaaaaagctgaattaaacagaacgccaagcttcagtgtcaatcgtgtcggagaagacactggcgtaactttcgctggtatccctctgggccacgagttcacatcattagtgttggcgctgctccaagtgagcggcagaccgcctaaggtggaccaaaaagtcattgatcaggtgaagaagatcagcggtgaataccacttcgaatcttatatcagcctgacatgccacaactgtcctgatgttgtacaagctttaaacatgatgagcgtgctgaacccgaacattacgcacacgatgattgacggtgcagcatacaaagcagaagttgaaagcaaaaacatcatggcagtgccgaccgtttacctgaatggcgaatccttcggaagcggccgtatgacgcttgaagaaattcttgcgaaaatgggcagcggcacagatgcatctgagtttgctgacaaagagccgtttgacgttcttgtggtcggaggcggacctgctggtgcaagtgcagcgatctacactgcacgtaaaggcatccgcactggggttgtcgctgaacgcttcggcggacaggttctcgacaccatgagcatcgaaaacttcatcagcgtcaaagcgacggaaggaccgaagcttgcggcaagtcttgaagagcatgtgaaggaatatgatattgatgtcatgaaccttcagcgtgcgaaacgccttgagaagaaagatctgttcgaacttgaactcgaaaacggcgctgtcctgaaaagtaaaacagtgatcctttcaacaggtgcacgctggcgaaatgtcaacgtacctggtgaacaagagttcaaaaacaaaggtgtcgcatactgcccgcactgtgatgggccattgtttgaaggcaaagacgttgcggtaatcggcggcggaaactctggtatcgaagcagcgattgatctagcaggtattgtgaatcatgttactgtgctagagttcgcgccggaactgaaagcagacgaagtcctgcaaaaacgtctctacagcctgcctaacgttactgttgtaaaaaacgcacaaacaaaagaaatcacaggtgatcagagtgttaacggcatcacatatgtagaccgcgaaacaggcgaagaaaaacacgttgaacttcaaggtgtattcgtccaaatcggtctcgtgccaaacacagaatggttagaaggaacagttgaacgcaaccgcatgggcgaaatcatcgtcgacaaacacggcgcaacaagcgtaccaggcttatttgctgccggcgactgcacagacagtgcgtacaaccaaattattatttctatgggatcaggtgcaactgccgccctcggcgcgtttgattacctaatccgtaactaatataagaaatccgctatattgccagattggcaggatagcggatttttctttttctacagaaaaaacccgaaccaggcactccggtaaacgtgctcgattcgggccagcttcttataggtcctcgccattcgtttgaatgacatttttgtaccactcaaaggaatctttcttataccgcttcatggatccgtttccttcattgtcacgatcaacatagatcatgccgtagcgttttttcatttcgccagttgtgaaggagacaatatcaataatgccccacggcgtgtagccaattaaatcaacaccatcgtacgtgaccgcttttttcaatgcttcaatatgcgattttaaatattgaatgcgttccggatcatgaaccttgccgtcctcctccagcgtatccactgcgccaaagccattttcaacgatgaataacgggatttggtatcggtcataaaaacgatttaacgtatatctcagcccggttggatcaatcgcccatccccagtcactcgaagtgatgtacggattttcgacaccattcggcaagccgccatttacaatatcgccagtgttatcatttttcacatcgcttttcacagttgttgacatgtaatagctgaagcctaagtaatcgacggttccgtttcttaaaatctcatcatcgccgtcttcgaatgtgatgttgtagccttcgcgttcaaattccttcaacgcgtagcttggataataaccgcgaacctgcacatcagggaagaaatagcgctgcctcatttcttcttcagccagcatcacatctttaggattggaggagaaaggataaatcggcacgtgtgataccatggccccgatctggaactctggattgatgtcttttccttttgccactgctaatgcgctcgccactaattcgtggtgcgccgtttgatacatgacttccttggcgttttcgttttcgccaaccacaacacctgaattcgtccataggaacaacggattgttcacatccatttggttgttgatctcgttaaatgtcatccagtacttcactttctctttgtaacgggtaaagcaagcctctgcaaagttgacgaagaagtccacaactttccggtttctgaagccgccatattctcttgccaggtgcagcggcatttcaaagtgagacagcgtaatgaccggctcgatcccatgcttcagcaattcatcaaacacatcatcataaaactgcaaacccgcttcgttcggttcagcctcatcgcctttcggaaaaatccggctccagccgatggacgtccgcagacattttaatcccatttccgcaaacaaagcgatatcttccttgtatctgtgatagaaatcaatggcttcatggtttggataaaattcgttttcttcaatcgtgtcagtgatttttctcggcacgccgtgtgcacctgctgtcatcacatcgacgacactcggccctttacctccttgattccatccgccttcaaattggtgggcagctaaagcaccgccccataaaaaatcctttggcatgtttcccatgtttaattcctcctcagcttacgactgtaaatattttttgatgtaatgcactttcctcaatctcttcaatgaaagcttatcaaactcaacaagcacttcgccttttttgacggtatcgccttcttttaccttcaaggaaaaaggcgtgccgtctaatgtcaccgtatccagcccgatgtgcgcaagcaattcgacgccagacgctcaacgcaggccaatcgcatgctttgtaggcgcaaccatgacaaccgtaataacgccgggatggtggcatcgattttacgatatccttcccttcgctttaggggtagaccgcttcagcaccaatcgaagtctggtagcgcagcgagaagtcccaatcacattctcttccccgcctacggcctctaaaatgtcttttgctagtctcgtataatctctcactttccccgacattttcacccaccccttcgttttggttacgctttcattataattgtatcggtataattcatcaataccgaaacaaaatatttacgcactaactatcattgtaagcggtttatgctataattttggcagtgaaactaaacgaataaatgaggaatgcgtatgttaaaataccagcaaatcgcagcggaaattgaaacatatatagaagaacaccagcttcagcagggagacaaactgccagtcctggaaaccctcatggcccagtttgaagtcagcaaaagcacaatcacaaagtccctagagctactagagcaaaaaggcgcgatctttcaggtcagaggaagcggcattttcgtcagaaaacataaacgaaaaggctatatcagccttctgtcgaatcagggatttaaaaaagacctcgaggatttcaacgttacctcaaaagtcatcgaactagacgtgagaaagccaacacctgaagcggcggaaaacctgaacattggaatggacgaggacatctactatgtcaaaagggtccgctacatcaacgggcagaccctttgctacgaagagtcttactacaacaaatcgatcgtgacgtatttaaacaacgaaatcgtctcccactccatcttccattacatccgggaaggactggggttgaagattggtttttctgatttgtttctgcacgtggaccagcttaatgaggaggaagcggaatatttgggattagaggctggactgccgaagctgtatatagaaagtatttttcacctgacaaatgggcagccgtttgattactcgaagatttcgtataattataagcagtcgcagtttgtggtgcaggctaatagttttttgctgtagagctgctgcactatggaaggtggtcgacatgtacaaaattatcattcctgccatactagctatctttgcactctggatactcttacagatttcactagagatgagcatcgttaagaatccaatgaactactttatcgtattcattatctttttcctctttgtaaagatggtgaaagaaaaacaacagtagtttgctttgaacaggaaaccagatttgacatctggtttttttgtgtttcactttattcactcgtttcaattgtctataaaagcagttatgcggtactatcatataaaggtccaatgatgaaaaacaatgtcatacttttacattcaccttatcatgcacatgatcatatataggggtttattctaaaaaggggatggacgattttggaaagcaagtacctagatctactcgcgcaaaaatacgattgtgaagaaaaagtggtaacagaaatcattaatttgaaagcgatattgaacctgccaaaaggcaccgagcattttgtcagtgatttgcacggggagtatcaggcattccaacacgtgctgcgtaatggttcaggacgagtcaaagagaagatacgcgacatcttcagcggtgtcatttacgatagagaaatcgatgaattagcagcattggtctactatccggaagacaaactgaagttaatcaaacatgactttgatgcgaaagaagcgttaaacgagtggtataaagaaacgattcatcgaatgattaagctcgtttcatattgttcctccaagtatacccgctccaaattgcgcaaagcactgcctgcccaatttgcttatattacggaggagctgctatacaaaacagaacaagctggcaacaaggagcaatattactccgaaatcattgatcagatcattgaacttggccaagccgataagctgatcaccggccttgcttacagcgttcagcggctggtggtcgaccatttgcatgtggtcggcgatatttatgaccgcggaccgcagccggataggattatggaagaactgatcaactatcattctgtcgatattcagtggggaaatcacgatgtcctttggatcggagcctatgccgggtccaaagtgtgcttggccaatattatccgcatctgtgcccgctacgataacttggatattattgaagacgtgtacggcatcaacctgagaccgctgctgaacctggccgaaaaatattacgatgataatccagcattccgtccaaaagcagacgacaacaggccagaggatgagattaagcaaatcacaaaaatccatcaggcgattgcgatgatccaattcaagcttgagagcccgattatcaagagacggccgaactttaatatggaagagcggctgttattagagaaaatagattatgacaaaaacgaaatcacactaaacggaaaaacatatcagctggaaaacacctgctttgcgacgattaatccggatcagccagaccagctattagaagaagaagcagaagtcatagacaagctgctgttctctgtccagcattccgaaaagctgggccgccatatgaattttatgatgaaaaaaggcagcctttatttaaaatataacggcaacctgttaattcatggctgtattcctgtcgatgaaaacggcaatatggaaacgatgatgattgaggataaaccgtatgcgggccgtgagctgctcgatgtatttgaacgattcttacgggaagcctttgcccacccggaagaaaccgatgacctggcgacagatatggcctggtatttatggacaggcgaatattcctctctcttcggaaaacgcgccatgacaacatttgagcgctatttcattaaagagaaggaaacgcataaagaaaagaaaaacccgtattattatttacgcgaagacgaggcaacctgccgaaacatcctggcagaattcggcctcaatccagatcatggccatatcattaacggccatacacccgtaaaagaaatcgaaggagaagacccaatcaaagcaaacggaaaaatgatcgtcatcgacggcggcttctccaaagcctaccaatccacaacaggcatcgccggctacacgctgctatacaactcctacggcatgcagctcgtcgcccataaacacttcaactccaaggcagaagtcctaagcaccggaaccgacgtcttaacggtgaaacgattagtggacaaagagctagagcggaagaaagtgaaggaaacgaatgtgggtgaggagctgttacaggaagtggctattttggagagtttgcgggagtatcggtatatgaagtgagggatgtggggttcagagatacattctctgggctcttttttaaggtcgctcatttatcacagcaaattgctagcaaggtctgttatgttattcttctcgttccccgagtacttaaagaataccaatacgaatataatttcaaaaaaaataattaactgctgtgttttgaaagccagaactcatttttgggcagtttctgcgtaatatttttcgagcatatttacccactcgccgacgttggagccgcagatgcgttaccttcacttcgaccgaccagataggaataatgaatttttcattcccggcgtttaagtccagttctttgcaatgtattttctgcttatcgttatttatggtacgggtggaccgttgtatgtataagttaggtttttagctatcttatttcatattgaatagttttgtttttaaggtgtttaggtacccctcccgttgaaatctcttcaggcactaagtctatttttaatagagtctatatgattccctcttttttaaagaacaatcaaccaaaaattatcttttatacaatctattatctatcaaaataaacctctcaaaataaattattgagaggcctcataaccaattaagaaaagtattcatattggcttttaacttataatttctttaacattctctgccatcgatttataatattgcttttttttgctcgtgtaacagcaacattaattaaattaggttgttaacttgacaaatctatcctttaacaagttgttttttaaagaatcagaacacactttccaaatctggaggaatcaaaaaaagatcgttgtacaaaatccacaccatcttctagttgatattcctgatcgatgattattcttgtccccgttctattttgtagctgaattgctctttctaaatcttcttttgaacctaggcaatttcctaaaatagaaacattcttaacaatactcatttctaatgctcctctgaccacaggctcagcatcacttggtgtgtcactagacaatagaggatgctgatctcgtaatccacaagtaacataagtcccgccagtttgtaagtaatataatgcatagccgatgttcatatcgaaaaacggatcaaaaacgtgagtaatcttctgcttgacgatatcatttgatgtactattaatagctgtacttactaattctacgcgactaggatatattttttgtttttctttatcactccactctgacgttgacaaacaaataggagtgatgccatgagagagtaactgttgaataataaacaatgaagtgtgtgaccgtgcactaaatactaacggattcccaccattcacaagtattccagagcgtcttatcatcgctgacgcggtttgggaacccaaagaaaaacaggcggcttcaatatcacttaagctttttggtacttttataatctttttcttatgaagacgcaaccaacccaacgatgcaaaatttgtagctacacccggtaaaattccttgttttccgctatcaggatatgaacaatcagacataacacgatctccgaccttaaattcatgtacgtccctaccgacagcaacaatatttgcgctaaattccgagccaaaaggaacaaacaatcgatcagaatccttgattgagttgtagttttcaagtagtatggctttatcacggtaattgcatgaaaaagctgtcactcttactaatacatgttcatgattcttcggattttcagcatcgaagtaaggttgttctaattcaactgttccaaacagtatatccacttcaccaaacttaacaattcctagctctgtataatccattgaattctttctactcggattaattgccactaatgaacgcactccatatcctccttatatatatttcgttgatatgaaacagagcttagattaagtggaaaccaagcagattcaccgttattatacatctttaacagaagtgcagaatcagctactccactccaaccgagaaagtatcccaagaggtagtctctattcttttccccagtataaaatccattatgattagctaaatccaatacagtttcccaatactgatttgcaagtgatagataccacgaatcaccggaagcttcatatgcaaatagtagagattgaagtacccccgcagccccatgacatatagataaatctacaggtccattttctggtaatattgttgatttcctcgctatatcatagagattgaaatgttcgtttaatgctcttgccatttcagctagaaccattagcaaaccagaatttccgttacaccaacctgcagtattaacagtattcggaaaagatatttgtacagcctttttaaaaagttgcttacatccttcagtattatttaaagcataagataatctaaattttgcccatataactcctaaatttccatgcgctagtccatcactagataacatactcgatgggctttcatggagaattttatcttctagtttttccagaacctgattcggcgtatccgcaaatgaagctaacatgagacttatacctaccgggccaataaatacatcaccattcggaatgttctctgattgaatttgagacacaacttgttctgtttcttctactctattcctattatggttaaatataaaatctaaagaacttgatcctgaaattattgatgttggtgcagattctaattgtgaagaaaatacactacgaagggattttaaacctcgtttggcctgattataaagattagtgtacttagaacgattggctattttttcatattctttaagatgctccaagagaaatagaatacccccactatcatgaagcgaaataagaggactagattcataggatatagggatatttccatacactcctccaatccatccagtttcaggattgtctgttttggtagtaattgataaagaacttattaaatcaatcaaaggattaggatcatcttttgtcacctttcgcaaggcatttgaaaataaaggagattgataacccaaatcatctacttttttatgctcagcctcatgtattctaatatcagaatatccttctgcaattaagcgcttatcaagtaacaatcttttttgtgaaaggttctctaaccgtcttattacattattttccggcgacacatcaaatatgtcatctgaaataaagtcccctgaatataaacgtttatcattcgccttcatagaaaaatatggaatatccccaatttttaaagaacgaatttcttcttctaatatactcttggctatttcagaatctctaattaacttaggtggcttaagatattttagcacttgatttattgcggtatcgtcaactaaattttccggaaataggcacgcatcaagcatcaagtaatactgaactgtaggtctattaactactctaattaaacattgaatatcagtaaatattgaataaatttgctctcgtttgtccatcatcttttcatatccatctgagtagcccttaagaaaatcctcttgaaatggaagtggatcgggcgcttgattactagttaacgtgattggtacagttgttcggtttacatcaatcttttccttggctatatctacagcatctgttcctgggtttttcagtgtaaaaaccatttcattagttttttgtggatagggtgtattaatagcaccaaccaatacctttcgaggaatcgtgagtttagctggaatgattgacgtagcagcaattgaataggaaagcatttcttccattaattggtcaagtaaaccacatgtacgattatatgctggttgtaaactagtttctaaatctacaaaataaggatatatcccgttaaaaataatattttcatcatgtaaatctgttgctccaagacagctaaacaccgccgcacataaaccgagattataataagcgctgccgacctctgattggcttatgggtgtatgctgcacaaacttctgccaaccgtactcaccccgattaactgtttgggcaactggtgaatggttctgtaaagaatcgaatttcagagtatcagaaaaaagtttatcgattaaaacatcaatctctaaagaccgaggcttatatagaacctttttcgacggtttaaattccaagcatagaactacttttgaaccattgtgaggatcggattcaagaggcataatagtttgtaatcttgatcctctactaattaaaccttctgataagagtaaagtagcatctctgctaaaattagcgcacacatcttcgataaaagaacaagtattattcactgattgtgtgaccatttttcgtaaacaatcatattttgtaaaccaattgcttataagttccttatcaattgaactgacatatcgatcaaacgcttttgatgatgaaggatcagcaggataagataaactttctcgatatttgtgaaattcatatacaaaagttttttgacacagtctccacacatgatattccaataatgcatgtaaacagttcgtagctgctatctcagcatgtgatacaacgtcttgccgggaaagaagttcttttatcttatagttagtaagttctaattcatccgaaaagtaactctccacagcaaggactattttatgtgctgccaattgcattttcaactctccccttttcaagctctgccccaaacaattttgcatacaagccacctatattaactaattcttcatgagatccactttgtacaatgcatccattttcaagaactacaatacgatcagcatttagaatagtctctaaccgatgtgctataacaatttttgtacacttaagttttgataatgcatcataaacatatgattgtgaaatattatcaagtgatgacgtcgcttcatccattatcagcaatttgggtgtttgaagtaacactctcgctatatgaattcgttgtctttgtcctccagataggtttgctcccgtttctgatataactgtattgtaacccataggaaattcattaataaatttcataaactccaacgaatcacaaagctcccgtatttctgcttctgtaagctgactgccgagcttgagattttccatgatagttcgattgtgcaaattgacttcctgaggaatatagctaattgagtctcttaatgtatcaagattatattcatcatactcaattcctccaaaatatatagaaccactagtaggttcaaataaactagcaattaccttcccaagcgtagtcttgccggatccagataatccaacaagagcaatcgtttctccatcagaaatatccaaattaatatttttaatgaccgggatactatcagaagtataactaaaactaagatttttaattgaaactgatcctgaaggcattccctttgaatctttacgagaattttctacaggatattcaaatatatcctctgctaatacaatataccgcaccgcaaccagagcttcagatgcaattgtaaatactgaattcacatagacgaacaataatgccacaatagactgaaccgcaattgcttgcccgagtgtcatgagacctagttctgccatatatatacctgtaacaagaataatcaaaggagcaaatacttgtattccggataatatcgatcctattattccttgctggatacgcattctgtggcttgttgcatttaagaattttctgaagcgctgtttccagtcatcgatataggactgaacgtagcctcctagtttcacgctatttatagaaactatagcatctaactgtatgctttgtgcgttagtcccctcgtgtagttctttatctgttgcagaatttacgtaagactgagcaataatcaaaaaggcaaaagttgataaagtaaacaacagtatcataattccgagccatggtgatatccaaaaaacatagactaatattgctacaccgcttaccaaatcaagacatgcttgtactaatgtggttcccaaaacatcctgtattcgtgtaagagagttgagccgataaataatttcaccaggcgctcttactgtaaaatactttgctgggagtgataaaacacgtgtaaaagcaccactcagaagatgccaactaaaacgataaattatctttattgagaagtaggttctgagaaaatttagaattaccataataattaatgctatgatgagagatccgagtattgtagcaaaagaagtagcgtcaccaaacccattgtcaattaatagctgtgtaaataagggaatcattaatgttattccaactaaaacaatactcattatagctatttttaaatatagacctatcaaattagatggccaaatatacttttttttccacctagaaagattgctaacgctgcgtttcttgaaatctattccaggttcagtagctagcacatactcttggaaattttcgagaaactccgattgggtaatttttatccgacctatcgatggatccatgattattacttcatgttcattatatgactcgacacaaacaaaatgataccctttccaaaaagctatgattggatagtttattaccttaagtgccctcgtgtcttttattcgataagttttggcattcatcccaaaatgagagagcaatttttttagttgttggaatcctagaccgtctctgcccggctctttaacttgtctgagctctgaaagtgaaatttgataatcataagcctccagaattgtcttaacacaacatagcccgcattctgattgtgctaattgtaaagttggcatgagtcttctttttttaatttcagaaaatattttcatgttagcgttaaaggggaaattttaattttaggatcaagtgatttacaaaggtgcaatagtgcaccagcttgacccgccatcaatcctgggcttaacggataacgacctttcccgtttttatagtaactaaaaatgtattctggagagccgaaagttgtttttatttctaaaagaatttctgatgtttcttctggaaatgattcacttacatactcaagcgcctctactattcccaggcttccgtgacaaagtaccggaatacgtgagatagggatcctttttagctgaccgattatattgagcactgattctcgagacagaacttttgatttgtatgcttcgtaataggctattaataggcctgctaaaccattacaccaagatgatgatacatgctcattaccggcatctttatatgtctctatgattccattattatttgtgtacttgttacagataatcgaatcaatctcttcaatcactctttttatctcgcttttttcttgtttttgattgaccaaagcaaaaaaccaaagtaattgactatatccatgggccaatcctgaagttgttttagcatcactatcattaattcttgagtatgccaatgagagagttttattgatcatatcatcacttaatttgaaatcttcctgcattcggtatctcataacaatcgaaccgctttttcccgtaatcatatcgaaaaaattattatcttctgattccaaagaacgatgcaatattggccaagacttaacagctatgtctttccatctttcgtttccgacgatatcccctgctgaaaataatgtccacagtagccctgaaactccagaaaatgcaccaattccagaaagaaggacatttctaagttcgtaacttctatcctcaagaattttcgctgatttttcaaaaatatcgtaagaagcttttaaagcaatatcgtccgataaaagtttaccagccactgccaatgcaagtgccgggccaactcttccgctatataaatcgtatcctaaaactcctggcgtccagccttgcccaaatcgtgcaacaggaccaatccaagttttaggtaaatgttcatagcgatcgtctaaaagtgattcagttaatgattttgaaaaccaagaaattatttccctatgctttaaaacattggcatcttttaatgtgttcagtctttctaatgtaggtctttcttcttcagtggattctgattcttctaattttaacgttccatcagtatggggatctgctaacttagcaacaaaagctagccgtattagattgatttgtttagtcaagtctgattttgtgagacttttcatcttcaaaataaatgctgattcgggacttgttgaaatagaagaaacaacttcatttccacaaaaaacttctgttcctttaaaattgacagaaaagtatggtatatccccattccaaagttgtttagattcagatttaaccaaattaatatcacttgtcatactcagtattccaatgcgcgacaataaagcatgtgccgtgtctatattcctggatggctctgcatctgttaagatacgtaaaagttgttcatatctatacgtcatattatgtatatagcgaaggttagcgtttctaaatgactttataactgcgtcaataaacaaatccttttgatcaaatatttgcatgaaaaaatcagagaaaccatcgataatttggtcacatctttcatgtatcaacgcttctaaatcgggatcagtcgatagagcattatcaatactttgacgtttccagacaacttttatatctgaagaaaaaccatcttttatatcgaaggttttaaaaggacttacactattctgatcacgaataccagtgaacccgacatcaactgaaccattacttgattttttacctaatgatattggaagtacacctgtaccatatactgacttctccattgcataatatgcgcttcttttagcctccggaattccagttctaacccgagatggatgaaacaaagtttccaaatctattggaagtggcccctcatttgtccataatatattactaaagtgcatatctgaagcatttaataaaaacattagacatgctaatctacctgcctgaaacatatccttcttgtcttcattggtttcttcaaaagatgtaaaaccatattttccaaaatcaacaacagtcagagaaggcatctttggagaaataaatttgttaatctcacgaataaaattcgtgtatccaagttctccggagactgaacgtggtttaaaaacaagcttttctccttgttcaaaggtaataatcgctactgaagacccattattatgtgtgtctccacctgactctacagaaacaatacggctagtgcatggaatgctgaatttttcctctatcttcagacgatgtttttgagtcaattgaatagtatctttgattgcaattgccttattttctaatacattattgcatcttccccatgcaattgagtaagtacccgcaaattctttaaattccgtatccattaatgtttgggtatagtactcataaatcatttttgaattcatagaccccttgggtaatgttttaatctgttcagcaaaacatcttattaggtaggagaaagctatctgtgagaacaactcacagatagcttttttgaatgattcaggctcaacgagatgcttgtccatctttgagtcccagactttctcccagatgtttcgcgcaatcatcctacaagggttatgatagggataaagttcccggtccttaaaactctccacattcttcagattatctggagaatgcggaggcaaatcatcaatataatggagaagtggtgcaatgtgttcatcgaaatccgccttttcaagttccgggtaaaactgtttcctatatataaccattatattttatctctcctttaacaagcgcgagtacaagcagtagtcggacaggtgttacttgaaatatatcctgtaataacagataaagccggtgtccaaccaccaacaacatcatcttcagttaatgcaatcatatctgattcaaggtattttccaagttctagctcgttttttaaactattatttgcaatagactttttatcattcattgtcatatcccctattcacataatattttttgacattatcacataaaagcatttctaattattaacaccaagccatacattctttactgacagtacaccagccacccttatttccccagtaatcacttagagagaatgtatttgtagtacatgctccaaatacatcatcatcaaattcttgatctacaacttcttcaaaccaagtaacttgttcttgtttaacctctttttgtaatttactgaattcagtcttcatattatttctccttttctttatctatttcagataaaattgactaaattatgaaacactagaagttcccgattataatgtattaccattgtttcagataaagcaaacacaccttataaatagcaactactcaacgtttttaaatccaatgtctgaatgggaaatagagccagtccaatcttttcttacagtaaatatccttcctctattaaaaacatcacccctttgcagaagctctggctcaattaaatgatgaagaccgtgagctattatggaaattttttaattcgttgacgaataatactctacaatattttccaaataaaagggaggggtaattttatacccctccctttaaaatcgtgatttcatttgattttttcttttattgtttttagctgctttttaatcgtttcaaccgatttgaacaatttttcagctatttgggctctacttagtcctttttcctttaacttgaaaacttcgcgttccgcaggtgttaatacacttgcctttctttctaatctaagctcattgataagcaaactcgaaacgtctgcattaaagcttactttatctgaatatgcttctctaatcgcctttggaatatctttataagaggttttgtttatataatttgttgctcctatatcgaacgattctaagatgacttctggctcgtcccaagatgttaacatgataatcttttcaaaacctttctcatttaattccctagacaaatgaagcccgcctaactcttcaccttcagataaagttaaatccattaatacaacatcaacgtctgaagaatcaatttgaagagcttcatctttagtaaatgcttgactaacaactatgatatcggtctctttttgaaccaattcagatatacatttcatccagaccgcatcatcctcaacaatcattaatctaattttatccataacattcccctgacaaattattcttatattcttggattggtgtaatattaagaactctgttttttggcaatgataatgttattgttgttccatggcctaattggctttttacagttatatcacctttatgttttgtcataacgttataacagtatgttaatccaagaccaaaattccccacctttttttttgttgaaaagaagggatctaatatttttgaaagcttatctttctcaataccttttccgttatctataaaatctatatgaatgtttttgcgagtttcatagattctaattgtcagtgttttgctgtctcccatagcctctatagcgtttttcattatatttatagctgtttcttgtaaatgaacgaaatctccatatacctgtgcatccacttcatatttttttaatatgtcaacttctgaaatctgtggttgaagtaagccgatgcttgacttgattaaatcactcatacgaaactcggattccttcagctccataatatctaattttttttgaatacgacttgaaagctcaaacaaatgatttgcagactttaaaatcaaatcaatggtttcatcattattttcttgattatgagtatctttcaattgattcgccaacaaatcaattttagccacttcattttttattgagtggtttaacaaagctgtacctgatgttacagctttcattgttaggtcacgtctttgtttttcaaactttatttgaacgcctagaaagccatatttagtgatgaagtagataaatagcaaaaatgctgctgttataacccacggattgagcatccaaattccgaataccccaaaagcctctaaaataatatttgtgaacactgcaaaaataagtgttggcacgactactaagcaagtgagtattttttgttttttagccatcttattcgtttccgaatatgcagagtaaaccatcaaagccaatgatataaaaacataaggaacaacccaaagggataatattacatgctgcgtcccccatataggataatctgtgaaaaaaacctgcatgatgataacgggaatgaataataacagcttccaaagaagtttttgccttggttttattgtatctgaaaatattaagccgaaaattaaaattgcatatgcagttccataatgtcctattgacgaagacagataatgcaaaaattgaatccatttagaagcatgatcaaaaacatatgataataagacacttaatccaccaaaacccccaccgatgccaatgaaacttccccatctggttttttcattttctgggtatgtgagcaatagaatagaactcatcaaccaaagtaacgcagtaagtataagcatcgtaatcttacctttttattttattttgaatgaatgaaagcgtatcatttgccagctttttgcgacaaagaacaatgcctgaatgaccacaattgtagacatatcttgtgggtttccccaactttcccataaataatctgcatcttttaagtcaatatactgatcatgtttagcagaaatcagcagaatgttatctttattaactttcggtaaagcttgactagcatctgtgatattccaatacgtcactaaatcttcataagtcacaccattttgttctaattcttctcttatgaatttacctgggatcgtgttccatattgaataagaaaggcgattggcataaaagattgataccactacatcaatttgggattctagggttgcaattagattagtaacccatcccctaagcttactcccactatgataacaggtccttttttatttgcttttatccagtgaattaacgcccgtaaatcgacaatggcctgtcttgtcgactcaattgtacgatcaatatttgcactaatcatcaactcgccactatacagtgaattttccggttctctttcaaaatggtatggaagagaataataatacatgttccagcctaaatcgttcattatacgattatgaaatatttttttgatcctattgtacgaatccatgcgccaaccgtgtacaaagatgacattgggttgatctatatcatttttatttaaaaaaacctccccttttaaagtatcattaacaagattcccagtttgaattaaggattcataactaaatgtaccaaccctataactttttttagatttattcaaatcaattgaaacatcagctatatttgcactgtaaacttcctctctatcatctatattggctgtaaaagcagcagaaaagtgtttatccttgcttctttttctgtgtaaatcatataaagccaaacgatctatcatttctgaaaagtgcactttctgtcctccttgattatttaaaatattgtgttttctctctgcattttatccctcaaagctacttaggtattttaaaccatctgtggaaatttttaatgccacgaactgattagattttaccactataagtatacattaacaatcattaggaaatcttattgaaatttcattttcatataaaagacataaatgatgaacaacaattaataataaagaatacatgtagaataaaaaaaatttaaggaacgcataaaaaacgttgtacaccatatataacaagggatgcaacgtttttattaatatttaaattcacaaaaaatgtaacattttacttatgagggcatgacgaaaagcctttccacgttttaaatttttgaaaaggcttataggattttacaatccaaattaatgtgaccctcttatcaagaatggtggttaccatacagtatttgatattcatgaattatgtcaatatggttttgatgcttagaaatgactttaggaaaaaattttttcattgtaaggtcgaaaggatttgtggtttgtttgttgaaagaccttgaggtagcaattagtgaggtagattggtaatgaaattaaagtaaaacggtacccatttttcaacatggttttcctcaaaatggcataagatctgggaaacagagtagggtaaccttcaaataagcctaaatctcttgtggaaacgtcatccattcacttacacttctgcaggtaattaaagttgtttcagcgctgtacaaagaaagtcgaagagaaaaatttctctcttcgactcgtcaccatggagtaagttgaatattcgtttaatttatcctatattttagctaagaacaagggcagtctattactttttttaaaatttgaacatactcttatatttcaatttttttgctctttttgagcacgagtacaaaaagtacgattaaaataaaacaaccaatgaagtactgtagaagcgaaagtggatttgagccaaccataactggatagaaataaccaggaaaattttcaattaagcctgaaagaaatttgttatgagtactttccaaaatattcgctaaaatattaggaaaaaaaagtaacattgctgttaaaataccataaactgcaccacttcgaacaccatataataataaaatataccctaacaagaaataagtcagcactagaagaaagacattaacaaagaatcccagaaggaaggtaaccttcaattctccaggcactccaagttgttgtgtaactagaagtaaacctattcccaatgctacataaagtaaactcacaagtagtgcaattacgacattggccaatacatagttttttctgttttgttttgagttgttaattaacgaaattgtcttagaagagtaatccctattgacaaaataaagcgggtgtaataccgccgccaacatccccaacatacaataaaaattggagacatgtttaatgttaaacggcgtatttgctgttaatataaagtaactcacgagtagtgctggtccaaaagctcccaacactccaacagccaaatggccctttttaattagttctttaaaattgtaattaacgtaatttttgatatttagtatcatgatcttcaccccttaatttgttcatatagacattacgaagcgtttttttctcagcagtaaaatcaattaaccttatcttcaactgatttaagaatttaaatatctcagtattttctgctgtcgtttcaatttgaattgttctctcgcttgtgtgaataatacttccgaactcctggctctcgataaatgttgctaagtcagtaggattatcaaaaactaattttagaatagattggctctccttactaaattgttgttcgtcggaaatagtgcctttttctataaacaaaactcgatcacagattgtttcaatatcttctagcttatggctggaaatcaagataccgatattccacacagtagccatttttcttaattgctgtaatacttcaagggatgtttctatgtccatactgtttgttggttcatctaatataacgtaacttggcttattcaataaacttatgacaatgcctaatttctgccgcattccaaagaatattctttcacctttttattcaatacatcaaataattgtagaccctttagaagttcctcgtattcgctaagtttgaatttatttccgtatatttctgaaaagtaggacagatgcgctaatcctgtcttattactgtatagtttgggttcctcaattaagtatccaacatgattattgtcttcaacagatccatcgaatgtctgaattgtttgagcaatgatcttcataagagtactttttccagcaccgttacttccaattaaaccaacgatttctccttgtttaaaatcaaaagatattccttttaaaactacagagctactatatttcttggcaattgaatttatatgcatttctaatcctcctatttagttctttaatttaaaaaatcttttttatatcgaacggctagatagattgctgaagcgaagaatgcaatagaatacttaaataagaagaaaacttgccacatatattcttttgggaaaatcaagtcgcacaaaattagtgcatataacatacagaggcaactttttaaagcgatttggtcttttctctcgtcagtcttacccatttttttatgaattacgattgtcagaatcaatccgactaaaagcaatacaaacccgctaccaatgagaatactccagtttccttgagaatgttcagcccaggactttaaagggagaaaaattgcgttagtgatagtatctgagatcgaattcattttcattgttgatcatttcctttctcataagtaaaaatctcgtttacatccacattaaaaaattcggcaattcgaaaagctaacagcagagtcggaacataatttcctttttccattacgaagatggtttgtttggaaaccccgactttctttgctaattcttgctgagacaatctggcaagtacacgatattcataaaccttatttgagattgaatcacctaaatttttcctcatgactttcacctcttgatcgaattataaactgtttttttataaaagtaaagttaacttatacaaaagtatgatgttctttatgttgtgattagacagatctttaaaatcatttttttcggtaattggaaatacgcaaatagttgaggcatttacactgattaatgaggatctgttatcgggtcaacgtcaaattagtgagccaatgtaccagtaagtttattctgagggatttttcaaattatgttttaagttcctgaaccagcttcaccagttcttgatgtactgtcgtcattctcgtatagtacaaaaatactctctttaatatgaatcctatttatgatacttttatgcgcaagagaggttgttttggttacaatttcttagccttaggcaaatgcatttgtgaacaatcgagcccgatggtgaagctaattacttgttaaaagaaagtgatatttggccttttaatgcttcaatactataattttcctcactggtaaatatggagatgatcgaaaggcaaaagaaggggaatacaatgatgtacggttctttgataatggagtgaaaataaggagctattaaattttccgtagaagcagaaatagttaaaatgatcttttctacatatgttgatggggattgaaaattgccaaccactcaataagcttggtaacgaacaaagaacaggaaagagttttcacagatcaacagtaaaaatcatactgaagtcagtactgactttatacgtactcaacttcaagaatttttagacctaaaagaacgtttagatactatgtaattcaggcaattacttgtagcgtctatttaatgcccatatcctagaaagcaggagttctagcggctcctgcctataatatggttactaacaactccccaatcaatccttcgggatttatattttaaagaaaacctctacttatttatgataaggctccccacgattaatccgaaaagcccgataaatctgctccaccagaatcaaccgcatcaactgatgaggaaacgtcatttttgagaatgacagcttctcatccgctcgcttcattaccgcgtcactcaatccgagtgatccgccgatgacgaaggtgactttgctttttccatatgtagccagcttatctattgtatcggctagttcttcggatgttttcatttttccttcgatggcgagggcgatgacgtgggcgtcggggctgatttttgataggatgcggtcgccttctttgtcttttatgattttcatgtcctggtcgcttaggttttccggcgctttttcgtccgggagttcgatgatgtcgatttttgcgtaggccgaaagacgtttggtgtattcttcaatgccttgcttgaggtatttttcttttagttttccgattgtcacaatattgatattcacaagtcatccccactttaaaaacaagttattcatatatgttgtccacaattgtggatatcttttctgtattttgtgtaagatcattcgttccccactatatatactgcggggtctccacataattcacaggctgtggataaactgttagtatgttcgatttttctgatttcgggcggcagctcgtggtcgtctatgtacatatccagcaccgtttcgatgtgttcttcacaagaataatacgcttgtttcatgttcaaatcctccgatgttttcttccatttttacaaatgttctcttctcaatataacctatttattcacatgttagtagtgcttcgggctgagttttatccacaattcgacaaacaagctgttgatgactctatttcgctcgtgtgttagtttggatgtaaccgatgtgtggggaggtttgcatttgcgctttagatgggtttggctttttgtgatcatattgctgcttgttgggtgtaagccgtcttattgggtgttggagaaggatcgaatcggtgaaggcagtccagacttagaaatatacgctaattaccttcaaatgcatgatgatgtaaaaggatatcaagtcttcaccattttagaagggagaaaaatggttattgtgtctctcggaagcagcgagaaagataagaagcttgaagtgtcagacgtcaaattctcacctaaagaaacgattgtaactgtgaaacgaatacctgctcctacggcaaatgagaaaaacccttatattttgattggactggacaaaatcgaaggggaattcatcgtacaggatgaaacgggaaaccgctttgaagaaacggattatcagcaataaagccggcgttctgagaacgtccggctttttcttttacttcagtgttccatgcgggtcgatgacgaattttttggctgcgcctttgtcgaagtcgctgtagccttttggcgcgtcgtccagagaaatgacggtggcgttgactgcttttgcgatctgcgctctgccgctcaggatcgctttcatcaaattgcggttgtatgtcatggcgggcgtttgtccggtgacgaaggtgtgggctttggcccagccgagtccgaagcggatttttaatgagcctgttttggcgtccgcatcctttgcgccgggatcttcggtcacgtataagcctggaatgccaaggctacccccgacctgggtgacgtccatgatcgagttcagcacggcggcaggcgcttctccttgattgccgtgcccagacgcttcaaagccgacacagtccactgcggcatcaactgtcggttcacctagtatttgttcaatttgctcgccgaggcggtcgtgtttttgtacgttgaccgtttcacagccgaagcttctcgcctgtgccagtctgtcttcattcagatcgccgacaatcacggtggaggcgcctaggagctgagcggagtgtgcagctgccaagccgacaggccccgctcccgcgatataaacggttgaacctgtttgcacgcccgctgtgtaagctccgtggaagccggtcgggaaaatgtcggacaacatggtcaaatcgagaatcttttctagcgcctgttctttatcagggaataccaaaagctgaaaatcagcgtatggcaccatgacgtattcagactggccgccgacccagccgcccatatcgacgtagccgtaagccgatcccggacggtccggattgacattcaggcacacatgcgttttctgcgttttgcacatcacacagcgtccgcaggcaatattgaaaggaacggatacgatatcgccttttttgataaattcgacatcccgccccgtttcaatgacttctccggtgatttcatgtccgagcaccaagccttcaggcgccgttgtgcggcctctgaccatatgctggtcgcttccgcaaatgttggttgtaatgactttgagaataaccccatgctcacattttcgattcacattcgccttcgggacgccggcccgtccctcaagattaactccggataaccgatatcctccaccgctacagtccctttgcctttgtacacaaccgctttgtttcctgtcaacgccattcctcccattcatgtgtttggactcttcgtccttgcacatgacttcggtttggcatgaccctttccctttctcacgactgttttttctgtattcttacaacaacaaatatgccaagaaagcagccaataatggttccggctatgtctaaaaagtcgactttacacccatttaacaggaacacagtaatggccgaaaccaggctgatcattactgccagaagaataacccgtttggtgcgcatgtaattcctcctttggattcgtttctaaaacatacccaaaatctctgcaaacttcggttcaacaaaaaaagagacttcataccagtctcttcataatttgagatcactcaaaaaatttcctgagaaataatgtgacaatactggttaccaacgcaatcgccgtatacataacaacccaaaacatgaatgagctattgcccgaagctaacgtaaataacaatatcaagctcgcgataaggacgatgagcggtgccacccaaaacctcttaaataaaaaatgacccgctataccaaatacacctgcgatgatcggaaaaccaaaaacgataaataaaacggcgatggctcccatactaacctccttgccttaaaacctcttcatcacctcaacatcatacagcttcaaatgactcttcggcgtcacgacatcctttaccttcccaatctctttttctttcattttctttccggttttcagattgtactgttcaatgtaggcaggcttgtgatacgtgtatgtgaagaaatagaggctgctgcctttttgggtgatttctttgaaatcggctttcattttgtccggggaaagggtgaaggcgatgcttgtttttcctgtcttggcatcgattttgtgtacctttccgaagccgtcaatgaaatacaggttcccgtcataagggaaaaagctgtttttaaagctgaagggcatggagctgtatatcgtttgttcgtcgtttttgtattcggcgatatcgtgcagctctactttgccgctttttttgttgatcttgaccatttgatagagattgtgggctttttggccgcgaaccataacataaacagcttggtcgtccacagcaagctgggattcgactgaggctccttcccggtactgccattccgttactttgtgataagtgagcttcttctgatctgcttgaatctgaaggagctcgtagcctttttcgtcatctgtcgggacgagtgcataaatggtgccgtcatgaaaaccggaggctcggatgtagtaggggatgacgtcttttttccactctccgtccatttggcggtacagctctgagcggtatccgtctccctttttgtcgtagccggagttgtataaggtgtaaaagccgtccgtgttttgcagaaagccggcgctgtcgcctgtgtgctgataggttcttttatgggagcgcaggccgtttttgatcgtataaatcttgtttttgtcctccagcatcacactgtcgccgtgaaccttggctgagcccagctcaaggcccttcatcttaaaggaagacagcgtcccgtcctggctgataaacagggcgtagcttttcccgccgccaaatgcatcttgatccgcagaggatgagaaatataacaggacttctttgtcatccaggaaatcggggtttctgagatcctgctgacttacggttttatggtttttgagaggagaaatgaagacaaatagtgcgattcctgcgagaatcagcatggcgatggtaatcatccactttttcatatccttctccttagtaaatggtcatgatggttgtcgtatacgaagaacttgtgatgtcgcgcggatacacgcctaagcctccgttgctgtctatatcaatgcctgctttcagcaaaaaggcagaccataggagctttgaacagtttttggcgccgtcatggccggtatttctgttattgacgaagttaaatgagtatgggtcgcccacttttgataccgcccagtcggcagcagctgttttttgagatgaggatacgctgacggtttgcacaatggagttgtcttccacgtctctggcattataagcgatctgcctgacgccgtcgctcgggacagattcaacaattttgtcagcagcggagtacatgccgacgtggccgtgattgtagtaggctgtgtaggagttcgtgtaatagatattgcctttcgcgcttgtcgggagttttttcgtgccggacgagccgcccatgatagacatgccgctttccttggcgagccggtctccctctgctttatcagccgtgatttccttatagaactgttttaggataacatcctgctttacgtgctgttgtttggcaatctggctggcagatttcatgatttcttccggtgtcgtgcctggctgcagtgcggcgatttcttcagcataatttgtggtctttacggctttggcgggagaaacaaataggccgccgcacattgtaagcgctaccaaaaacatcgacactcgtttcttcaacttcattacatctcctcttttcttgtgagtgtaggaaaggtaatttcctcacccacattatattaggaaaataaggaaagtaactaggttatttacagaatttttagaaaccatttaatgaaaaaggcctttatcaggcccttttcattaaatcttcttgctcatcactacgtctgtttcttgaaatccggtttgctcatatagctttcgcgccgtctgattatgagcaaagacatgaagggacagcttgcggattcccatactgcgtgctgcttgatctaatgccgccaatgcttgctttgcgtagccctttccccgatacggttcatataacccaaaatcataaataaacgcttcctgttgcggatgttccggttcagcatgtatccagagccagccaacgatatccttttcattcagcttgaggctccacaaatggtgatggggtgtttccagccctttcgggagcagatcagtaaacgcctgcttagacaaaagctgtgcatcttcaggcatccatgttcccgcttttaccttttctttcgcgtaatgctttgttgtgtatgtgagataagaccgaaattcttctgtctgcatagggctcagcataattgtcatatcatctctccttcatatattgactagaggattttacataaaatagaaagaggtgttactatcagaataagcaactgagattgataagtcactagagaaaggagtttcacatgaataagatcgcacccgcagaaatcgctagcatgctcaacgattggtaccttgctatcaagaaacatgaagttgaagagtcctcccgtttatttgaagaagtgaagcctttattggatgacatggaagaggatcaggaggtgctggcctacttctccttattggaactgcgccacaaggttttgcttcacgaggcgagaggacagggctttcagcatgaggagccttctcatatgaatgctacgtctgacatgctgaaatattacttttttctgtttgaaggcatgtatgaggcctataaaaataattatgacattgccattgggctgtataaagatgcagagcagtatctcgacaacattcccgatccgattgaaaaagccgaatttcacctgaaggtcggaaagctctattataagcttggacaaaatattgtatccctcaatcatacacggcaagcagtcaaaacattcagagaagagacagattataaaaagaagctggcttcagcgctgattaccatgtcaggcaattttacagagatgagccagtttgaagaagctgaggcttatttggacgaagcaattcggatcacgagtgaattagaggatcatttttttgaagcccagcttttgcataacttcggccttcttcatgcgcaaagcggcaaatcagaagaagcggtttcgaaattagaggaggctctacggaacgatgagtatgcccgctccgcctattattatcattctgcctacttgctgatacgagaactgtttaagatcaaaaagaaagaacaggccttatcttattaccaagacgtgaaggaaaaattgactgctgagccgaatagaatatgtgaggcaaaaatagacattttatatgccatttatgcagaagggggtcatgcggaaacgtttcacttatgcaaacaacatatggatgacttgttgtccgagaaagagtatgacagtgtaagagaactttccattttggctggcgaacggtatagggaacttgagctttacaaagaagctgcccactttttttatgaagcattacagattgaagaactgattaaacgaacggaggttatataaatgaaaagatttctgattggcgcaggcgtcgcagcggtgattttatcaggttggtttattgcagaccatcaaacccactcacaggaaatgaaagtcgctgagaaaatgattggataaatgaaaaacccccgcgggtgcggggttttcttattacagcagcttcttccctaacagggattctacgagctctactgctgttttacccgttttgtttttgtgatcaaggatcgggttaacctcaacgaattcggctgaggtaatgatgcctgcgtcatacagcatttccatagccagatggctctcccggtagctgatgccgccgacgacaggggttccgacacccggtgcgtcgttcggatcaagtccgtccagatcaaggctcagatggacgccatcacatgctgataaataatcaagggtttcttcaatgacctttgtcatgccaagacggtcgatttcgtgcattgtgtacaccttcatgccgctttccttaatgtacttgcgctccccttcatcaagtgaccgggcgccaatgatgacgacgttttccggtttgattttaggcgcgtagccttcaaggttaaccagtgactcgtggccaatgccaaggctgaccgcgagcggcatgccgtgaatattgcccgatggtgaagtttcaagtgtattcaaatctccgtgcgcgtcataccagatgacgccgagattatcgtaatgcttcgctgtgcctgcaagcgtgccgatcgcaatactgtggtcaccgcccaggacaagcgggaattttttctcttcaatgactttgttgaccttttgcgcgagtttttcatttcccgccaaaacggaattcaggtttttcagttcctcgtcatttttgattttttcgcggttgatcggaatgtcaccgagatcttcaaccgtataccccatgtctgagagccgctcgatcagatgagcgtaccggatggcactcgggcccatatccactccgcgtcgtgcttgtcctaaatccattggcattccaataaccgaaatcgttttatccatctgtgattccacctcaacatttaagataatgtcctatgcgggttctaacaaagatgacttgcggacaacgttttaaagctctagctgacgattcgcctgctggcgttttttaatgacgacatgataaatgatgtagcaaatgaccataaacggtacgccgcaatacagcgcgatacgctgctccggatcaaatgcaagactgatgagcacgaccgtatttaacgttaggccgatcagcggaagcaccgggtacagcggtgttttaaatttcaaatcttctatcttcccgccctcacggatatatttgcgtctgaacatgatttgggaaagcgaaatcgtaatccagccgacctgcgcgctcatacccgccaaagataacagcaccatatatacagtttcagcctgcgcaaactttgtcagaagtgataggcaggccacagccatcgttacgattaacgagtacatcggcacaccgcgctgatttgtttttccgagcgctttgaaggcctgtccttcattcgccatcgcgtacagaatacgtgtcgatgcgtataaacctgaattcgcaacggataacagcgcgattaaaataacaaagttcatgatatcagctgcatatgggattccgatttgctcaaatacggcaacaaatggactttccacgacacccgcctgtttccacggaatcatgccggcaatgacaatgattgaaagcacaaagaagacaagcgttctccatactgtctgtttgattgaccgtggaatcgttttttcagggtcttcactttctccggctgcaaccccgatcagctcagtcccctgaaacgcaaagttcacggtaatcatcgtaatcagcattgcctttatgccgttcggaaataacccgtcttcataaaaatgtgtcaaaaacggcgactgctctccgcccttcagatcaatcaggccaaacatggcagctccgccgagaataataaataaaaggataatcagaattttaatgcctgagaaccagaattcagattccgcaaaggcttttgtggtgatcgcatttaaaataaacatcagtgccgcaaagaccagacaccagatccacacgtctatatgcggaaaccagcgttgcatcagctgccccgctgataaaaattcaatggcgcatgtaaccgcccagccgagccagtacagccagccgaacgcaaacccgaaagccgggctgataaattttgtcgcataggtctggaaggaccccgacacaggaaaggcgactgccagctctcctaagcagagcatggtcaaaaacatgataaagccgcccactaaataggacagaaccgcgccgagcggtcccgcttggttaatggtaaacccggttccaaggaagaaaccggttccgatcactccgcccaatgaaatcatgaacaaatggcgtgatttcattgtccgctggagctgatttccgttatcttggtttgtattcacattctgcaccccttcagcaacttgtattggatctaagctggaacatctgcatggtgctatcccagtttgctgtccaaagagtctctatctatttaatataaaattcacttcttctcataaagatacattatactaaaatactgtagctgagcaaatagggagtgctgatttttctgttgtaaatttatacaaacgaagtgaatatcccgccatggtgcggatttatgcgtttcgcagcacgtgcttaattttctctatcgcccaatccaagtcctctttggaaatgattaatggcggtgcaaaacgaatgactgtatcatgcgtttccttgcataaaagtccctcttccttcaaacgctcacaatacggacgtgccgcttcagtcaattccacaccgataaacagccctctgccgcggacttctttaatgacagggctgtcaatactctcaagctcgcttttaaagtattcaccaagttcaagagaacgatccgccagcttttcatcctccagcacttctaatgaagcgatagacactgcacatgcaagcgggtttccaccaaatgttgagccgtgtgagccagggttaaacacgcctaggatctcgcggtccgccgcaatgcaagagatcgggaacacaccgccgccaagcgctttgcccaagatatacatatccggaacaatgccgtcccagtcacaggcaaacgtcttgcctgtacgtccgagacccgtctgaatttcatccgcaataaacaagacattctcttccttacaaatcgccgccgtttcctgtaaaaatccttcaggcggaatcacaatgcccgcttcgccttgaattggttcaaacaagaatgccgctgtattcggcgtaatggcctgtcgaagcgcttccacatcgccgtaaggaatgagtttgattcccggaagcatcgggccgaatcctcgtttatattcctcttcagaagaaagagataccgccagcatcgtgcggccgtggaagtttccgacacatgcgataatttccgcttgattgtcagctacgcccttcacttcatacgcccagcgtctcgccgctttcaccgcagattcaaccgcttcggctcctgtattcatcggcagaatcatctctttgcctgtcagtttagctgttttttcgtaaaacggcccaagctgatcgttatgaaacgcgcgtgacgtgagggtaattttatcagcctgatccttcaatgcctgaatgattttcgggtgtctgtgcccctggtttaccgcagagtaagcactcagcatatccatatattcattgccttccgggtcctttacccaagcacccagcgcttcagaaataacaatcgggagcgggtgataattgttggctccgtaatgagacgtctgatcaataatttctttggatttagataaagctgtcatatttgaattccccctgttttctgtttcaacatgttatcctgctttccctttatataaatgcaagttctgtgccaaatcaagaattcgtgtgttttctacaattttcgaggacaaggtgcaaaaacattctgatatttcgagcgaaaatttcagcaagtgcaaaattcttttgcatatcctctccgtttttttataaaatagaagcaatattaagaaaataattgagggaggttcatacagtggtcaaagacagcgaattcctcacattggtttttcagagtattttagatgaaatcgatgttggcctgcacgtggtagacgagcatggaaacacaatcgtttataacaataaaatgatgcagattgaagatatggagaagcatgacgtcttgaataaaaacctgatggatgtgtttatgttttcaaagcagcaggacagcacactggtacaggctcttcaggaaggcaagacgattaaaaacgtcaaacagagctatttcaataataaaggccaggaaattacgacgatcaatcatacatatcccatcgtccaagacggcaaaatcaggggcgctgttgaaattgccaaggatgtgacaaagcttgaacggctgatcagggagaatatgaacaaaaaaggcagcacaacctatacgtttgacagtattctcggcaccagtccggccattcaagacgtcatcgaaaacgccaagcgggcaacccgtacgtcatcatctgtgcttctcgcaggcgaaaccggtacgggaaaagaactgttcgcgcaaagtatccataatggaagcgatcgttctggcggcccgtttatttcgcaaaactgcgcggcactgccagacagccttgtggaaagcatcttgttcggaacgaaaaaaggcgcgtttaccggcgctgtcgaccagcccggcctgtttgaacaagcccatggcggcacactgctgttagatgaaatcaactcgctgaatctcagccttcaggcgaagctgcttcgcgcccttcaagaacggaaaatcaggcgcatcggttcgacaaaggatacaccgatagacgtacgtattattgccacgatgaatgaagacccaattgatgcaattgcaggcgaacgaatgcggaaggacttgtattacaggctgagtgtcgtcacactgatcatcccgccgcttcgggaacgaaaagaagacattttgcttctcgcgtcggagttcatccagaaaaacaaccatctgttccaaatgaatgttgaacacatcagcgatgacgtgaaacaatttttcctttcttatgactggccgggaaatattcgcgagcttgagcatatgatcgaaggcgcaatgaatttcatgacggacgagcacacgattacggcttcccatctgccctatcaataccgaatgaaaatcaagccggctgacatcccagagcctgaaacaccaagacaccagccggccgcggacttaaaagaaaaaatggagagcttcgaaaaatatgtgatagagaacgtgttaagaaaacacggccataacatctcgaaagctgctcaggagcttggtatcagcagacaaagcctccaatatcggctgaagaaattttctggctcgtctaacgaataatctgggcaggtagcctgatcagaaaaacagttcctttgcctattttacttttcacgtcaatcgacccattgtggctgtcgataatcgatttcgttatggcaaggcctaatcccgaccctccatattttcgggagaatgctgaaaatgaaggtatttgctaactgctatttgctgtttcacgtgtaacaaccatcttgtatttttcttcatattcgatatatccttttcaactgaacgggcgtgacccctgttcagtttttttttgcatatcaaaacagcctggcaacgatgccagactgcttttattaactgcctaattggtctgcggacgacagcttgatgtcaacagatttttcttttccgccgcggtaaaacttcaccttcacccggtcaccgacttttttctgataaagccgttttcgcaggtcaacaatatcatttactttgtatccgtcaaattccgtgatgacatccagttccttcagccccgcttttccggcaggtgaaaaggcgtctacacccatcacaaccgctccattggtgacgttcttaggaagctttaatgtttcatcccaatgatagcttgcgatgtcacttagcgatttcatctcaatgccaaggaacgggcgtttgacctttccgtatctctctaaatcctctatcacagggatcacgagcttagatggaatcgacaggccaatcccttcaaccgccgactcggcaattttcattgaattgatgccaatgaccttcccatccatatttaacaaagcaccgccgctgttcccagggttaatggccgcatctgtttgcaggacttctgcgttccagtcaggctgtccatcaccgtttgaatccactgggatcgccctctccgtacctgagatgacgccttgtgtgacagagcctgcaaactcaaggcctaacggattcccgatcgcaataaccggctcgccagacttcactttatctgaatttccgaaatctgcgactgctttaattttattgcttttcacccgtaaaacggcaaggtccatcagctggtcgctgccgacaagttcagctgatatgcgtgaaccgtctttcaagctgatttcaatttgggaagcgccttcgatgacatgatggttggtcacgacataagcggaatggtcatttttcttatagatgacgccagagccgctcccagcctcgccgctctctccccaaatatctgatttttggatgttcacaacaccgacaacggcgggcgacatattgctgacaatcttggtgacggcattgttgacactgacattcaccgtcctgattgattcccggccattgttgttttgctgctgatctaaggcgcctgtatccagcccttcatttgaaaggtacggcatgataaacgccattaatacggcaccgacaatcacgccaatcagactcgaaagaaaatatccttttttgcttctctttggctgttcaggagtagtatgttcttcctcacgttcgtaatccaccatattccatcctttccaagaacgttaatatggttatattgtgggttagaaactcctagaatagtcatgatttacatagaaaaattatacagcgcaaagcggagtggccttcttcggatcggtgtcgtataagtcaaatgtctcacccgtcacaaatcctttagaagccaatgtctgctgcacagacattcttgccagctccttcatgttgttgtcctggctcaaatgcgccaggtaaatacgagacgtctcatcgccaatgacatccgtcatcgccaaggcagcatcttcatttgacacgtgcccgacgtcacttaaaatccgccgcttaatgctccatgggtatcttcccatttgcagcataccgacatcgtgattgctttcaaacacaaatacattcgctgaacggataatgcctttcatccggtcgctgacatatcccgtatctgtcattaacgcgagctttcggccgctataatggaatacataaaacatcggttccgccgcatcgtgggaaacgccaaacgattcaacatcaagtccgccgaacgacttcaccgtctccattggaaatacaaacttttgatcggtgtcaattttgccgatttgattctccatcgctttccaagtcttctcattcgcatagatcggaagcttgtactttctggcgacgacaccaaggcccttaatatggtcactatgctcatgcgtcacaaaaatgccgtctacatcatccagcttacgcccgatctgcgccatcagcccatccatggcttttccgctcaaaccggcgtccactaaaaatgcgtgatcctctgtttcgaggtaaaacgcatttcccgtactcccgctcgcaagtacgctaaattgcaagctcatgtttgtctcactccattattttcattgatctgtatctaaaatcgtactctccaaagcattcacagtaaaatactcttgtactgtctttttctcaccgttcacttttttctcgtactcgaccgtaattctccataccggcgccagcacctgcgtacttgtcagcggatattgtgctacatagccgaatttacagctcttcacagtgctgtattcttttaattgattttgatagtacaatagctcaaccgcatccatttcagtaattaagctttctttctggatttgcttgaaggtctcaagcgtagtctggtcgtatgacacaacctcgtttttaccgtttaagtgcaataccacttgcccgatcatattagcgggattatcagtcttttggtaaatataatggccttcgtacgtttggaagaaaataatttctttcttcgatttattaaccttccaaagcttatatttttcgccatcttgaatctttgaagaaacaagtgcctgggcatcgtcctcgatatccttcttagatagggcgatgggatttgcaaacttcattttcaggctcgttactttatgatcatcactaggcatgtccatcaaaggcttttgatccttcagcgcctcaatttcctccttggagaaagacttttgatttgccgtgatccgataaccttctgtcgcttccttattcaaaccttcatacgtgatatgatcggccttcatgtcatgctcgacatcatttttaatgacttcatattctttgccggtagcctgccatttttgaaaaaactgatagcctaagaaaatatctaaaatgaggaaggcaacgatgaagattgattttgtcttattccactccactgttagccccctccttcctcaataagtcctttgtaatcggcacaatttttccatttactttcatcgcccaaaccggttccagttcaacgagaggatcatcgttggttgatgttgataccaattgataagcaaggaagatctgatcaattttgtccgtatcataagcggtttgtttcgaaagcagcatcttcacttcgctgccgctcatgagctctgtttcacttgttttaatcggattcgttccgagactgtaattcggccgcttatagctgagaatatcatcattcgcccattgcaccgtaatcgccgatgtcgctccgaaaggtttggcggtgctgttaatgaccgggatctgatccataaagatatagaagctcagctgctggctgtcattgatactgaaaaattgatagtgatccgtccagcttccggtatcctcaaggtatttttggctctttttgattaactcacctgtttgataggatgtgctctgcaccaaattgcgctgctggaattgcacctgtcgctggcttagattcacatctaaacggctgatcccatctgtcagcacatttctgttgttgtaattcgaatcttctcttacaatgctcggatcactaaacaaagcctgcttaaaggtatttgttttaatcgattctgtgacaaattcttttttgtccatcgtaagcggtttgttcggcagcaagaactctttctttgagccaatggagaacaaactgaacgccggcatatttgattgcctgtttttcaagtcgttcataatgttccggtagtttgccgattcaaccgtcacttcaagaatgagctgtttgctgtaagacaccaaatagattttcttgtttgcttttgtttcattgaacgggatcagaatatggtcaaacgaactgtattcaaacgactgattagaccatttaaacagcgtttggaaaatatcaatcggaatcgtatcgctgaattgcaagtcaagcttggcttcagaaccgcctattccataaaaccagctcttgaatccagacttgtcatactgatccgaaatatctttaattccttttacatcccaatgtggcaaatcagaccagatttcttcatagagggcattgtcatccactttgtaatgagcgccgtcatcatggataaacatgtcccttggccttaccgtttcagacagcttttgggtggttttttcgattttatgtttcacacgaacagtagactctgttgaggatgagccttcagaaaagtttggctggaacgtccatatcccccatgtaaaaacaagactgatgacgacgagtaccgtaagtaatatcgtttttatattttcacgcttcatcccaatcatcctcttgttcctctttatatggaagagtaaatgtaatcgtcgtgccttttccttctatgctgtccgcccaaatatctccaccgtgcgcctgtaccatttccttggcaatcgccaatcccagaccggtgccgccaagctttctcgttctcgctttatccaccctgtagaagcggtcaaagactttttcgacatcttttttcggaatgccgatcccttcatccttcacgctgatatagagaagttcttcctcttcattgacatcaatcgagaacgtgacatgtccgccttccggtgaatattttaaagcgttagaaataatattatcgagcacctgcgttattttatcctggtcaatctcgacatacagatctctgtccggcagattgcggataaactccacatgctgctcttttgtcatttcaaaacggtcaataataagtgacataaaccggacaatctgaatccattcccggttaaattgataatctttactgtcaaatttcgacagctgaagcagatcattgacaagccggatcatacgctctgtttcattttgcgtcaccattaagaagcgcggagcaatgtctttattttcccacgcgccttcagctaacgcttctaaatagctgcgcattgtcgtaagcggcgtccgcagctcatgtgatacattcgcaacgaattctctgcgttcctgatccattttctcttgttcggttacatcgtaaatgacagcgattaaaccatcaattttgccgtgttccctttgaatcacagagaaattcacgcgaagcaccgttaattcatcatcgcgctcaatttcaagcagcatagaatcctgctgctccactaaatcttcaaaagtataattctcttgaagccccagcaaactcgtaatcggcatttctaaggctgtttcacgtgaaacgttcaacagctccagcgccgggctgtttaagagaataatcgctccgtttcggtttgtggcgattacgccgtctgtcatataggcaatgacagaggctagctttctgcgttctccttcagtcatcgcctgggcatcttcaagctctctcgttaagtggttaaacgttgtggccagctgcccaatttcatcatgcccgtactttttaaccttcctcgagaaattccctttcgcaagctccatcgcctgctttcgcatatctgaaagcgggtgggtaatggttcttgccagaaaaataccgagaagagccgtcaaaacaagtgccaaacctgtgccggacgccagtatcgtgttgatcgtcttcatttgattaaagacatcttccatactcgcgacaacatagatcgcgcccacaacctcttggttttcagtcatgacgggcttcgcggaaataagaactctgattttgcttttcgggtcataatattttcttaaatacgactgtttggtagaaaaaattcttttgaaaatcagatcggtcgtttgtttccctgctacttcctcaccatacggctttgaagaaccgaccacttcatagcttttatctacaaagctaatttcccgaacctcatcacttttcgtgaagtcattcaaaatacggctgacgtcatcctttatgacggtgctgtcgttatcgctcttatattcttgttcgatataataagaaaggttgtcgattcgctgattcagcgattgttcataagagctgattagcgacttctctacctgattgacaaaatacacaccaatgatttgcatggcaatgataatcaaaagcacataaatcaaggtaatcttaaattggatcgaccgaaaaaaaccaaccttattcatatgggcattagtcctgttctgggtttctcaagtaataacctacaccacggcgtgtgacgatccaatttggatggctcgggttgtcctcgattttttcacgaagccggcggactgttacgtcaaccgttctgacatcgccgaagtaatcatagcccaaacggtttgaagcaaatgttcacgggtcatcacttgtccgatatgttttgctaaataatgaagcaattcgaactcacgatgagtcaattcgattgtttcgtctcgttttgatacaacgtacgcgtcagggaagatgacgagagagccgatatgaatctcgttagaggaaggctcttcctccgcaggcgctgttgtcagctggcggcgcaggttcgctttaacacgcgccaagagctcgcgtgtgctgaatggttttgtgacatagtcatcagcaccgatttcaagcccgataaccttgtcaatttctgaatccttagccgtcagcataatgattggcatatcgtatttctttctgacttcgcggcatacttcaacgccgtctttattcgggagcataatatctaaaagaattaaatcaggctgaagctcttctaccatttcaacggcttcgtttccgtcgtgggcacagtgcacttcatagccttcttttcttaagttaaattccaatatatctgcaatcggtttttcatcatctactacaaggatctttttatccatcattttgattttcctcctgccgaatgacttcatttcatctatataacattcgtttcatcacttatggcccatgtaaagaatgggtccttgtctattataacggtttaaggtcaaaagataaaaaaaataaaggtttagaaaaaaaacacatgtttcacctttatcgccagttgtttatctattgtcatgctggtcaactttttttaaaaaagataactttattgaaacctcccctcaccggagtgcgtctttatcaatgacgtcttcttctttgaaccggccgcagggccggttctccctttttcttctattataacactcctcatgtttgcctttttcctaaaagaaaaaacgcacctacgattgcagatgcgtttggtaagtggctcgggacggaatcgaaccgccgacacacggattttcagtccgttgctctaccaactgagctaccgagccaaatgttttatttttctctactaagtaaagtaaaatggcggtccggacgggactcgaacccgcgacctcctgcgtgacaggcaggcattctaaccaactgaactaccggaccttacagtaattgcccggagagctgtcgtgtcagctctcacagacaaataaggaatttagcaataacgctaaagtaaatcaatgacccgtacgggattcgaacccgtgttaccgccgtgaaagggcggtgtcttaaccgcttgaccaacgggccttcacgaaatggtgagccatgaaggactcgaaccttcgaccctctgattaaaagtcagatgctctaccaactgagctaatggctcttaaagatgtcggaatttctatagagcaaacgacttagatctagttctcatcttgtactctattgaagcagtttccgtaacaacgagatttataatatcacgaacaaatagaagtggcaataacttttttggtttttttcatatttttttctcagaccaacttatatgcggctttcaaacaaaaaacaagcccctgatataggggcttgttggcatattctatttagttcgcacggtacacactgcgaaggacatttgtttgtgagcggtctggaccgacagagaaaatagaaagcggaatgcctgtcagctgagacacacgctcaagataatggcgcgcattttccggaagctcgctcaagctcttcgcacctgtaatatcctcagtccagcccggcatttcttcatataccggctcacattcagcaagtgccttaagacttgctgggaattcttcaatgatttcgcctttgtagcggtatgccacacagattttcaacgtttcaattcctgttaggacgtcaattgagttcagagaaagatctgtaattccgctcacacggcgggcgtggcggacaacaacgctgtcaaaccagccgacacggcgcgggcggcctgttgttgttccatattcgcgtccgacttcacggatttgatcgccgatttcatctttcagctcagtcgggaaaggaccgtcgccgacacgagtcgtatatgcttttgatacaccgacaacgtgcttgattttggtcgggccgacaccagaaccgatcgtgacaccgccggcaaccgggttagatgacgtaacaaacgggtatgttccttggtcgatatcgagcataacccttgtgcgccttcaaataatacacggcgcccttcatcaagagcatcgtttaagacaacagatgtatcgcaaacatactttttaatctgctgtccgtactcataatattcgtctaagatatcctcaagtttaaacccttctgtctcgtacattttctcgagaagacggtttttttcttcaagattgcgctcaagcttttccgcaaacgcgtcacggtctaacagatccgcgatgcgaattccgatgcgggctgctttatccatgtaagcaggaccgattccttttttcgttgtgccgatcttgttagcccctttacgctcttcttccacttcatccaatttcaaatgatacggcagaataacgtgagctctgttgctgattctcaggttatctgtactcacgttgcgctcatgaagatacgcaagctctgtgactaatgctttcggatctacaaccattccgtttccgattacacacgttttatccttatagaaaattccagacgggattaagtgaagcttatatgtgattccgtcaaacttgattgtatgccctgcgttatttccgccttgataacgggcgatcacttctgcattttctgataggaaatctgtaattttaccttttccttcatcgccccattgcgtacctactacaactactgaagacatgtccgtgcacctccgttaacctttcaaaacgattctattcaaacaaatcaagtttatcagtgaagaaacagaaagtcaattgtaaatccgaacattaaattaatgtaaatctatattcgttcgcttccattcgttttataagcgttttctctcggttttgtcataaaaagcttgcgaaactttcatcctttagcataagaaagaatcacttgcctgatatcccttttgaattcataaaaacgacccgccagccgtccgggtcctctatcgtcacgcccccattgctccagtacgggttctctgattcgacctcttgatagcccatgtgctttagctttgaagtgatcgctgccagttcatctgcattcggcacataaaaaacaagaaggctgtcgggatggggaacgggggcagcgcttcccccttcatactgggtgaattctaaatgataatcgacatgaggaaggccgaacatgacaccgtcatacccgttatgttttgaaaattctcctattcgtttcaaacacagtccctcttcgtaaaaacgaataatctcatcaagctggcccgtaggacgcgcaattcggatttgtgctgcttgaaaagacgaaaaacgttttcccatattgttaccatctcctttttgcaccattttattaaaacgctttcaatttttcatccgctgagcgaacggtatttcttccatctttcgaatgaaaaaaccccaagagcagctcttggggcttatgcgccgggcggaacgcctgcgtcatcaaaacgccgttccaggttgacgaatttgttgtattcttttacgaacgcaagagacacggttcctaccgggccgttacgctgtttggcgataataatttcgataatatttttattctcggtttctttgtcatagtagtcatcacgataaaggaacgcgacaatatccgcgtcctgctcgatacttcctgattcccggatatcagacatcatcggacgtttatcctgacgctgctcaacacccctggaaagctgagaaagcgcgatgacagggacttgcagctccctggcaatcgacttcagttcacgggaaatttcagatacttcctgctgacggttgtcctttgaacgaccgcttccctgaatcaattgcaggtaatcgatcaaaatcatgcccagcccgctttcctgcttcaagcggcggcacttggcacggatttcactcactcgaatacccggtgtatcatcgatgtaaatcccgctgttcgataggcttcccattgccatcgtcagcttgccccaatcctcttcggtcaggttacctgtacggagattctgggcattgatatttccctcggcacagagcatacgcataacgagctgctcggcacccatctcaagactgaaaatcgctacgctctcatcggtcttcgtcgccacgttttgtgcgatgttcagggcaaaggctgttttccctactgaaggacgggcagccacaatgatcaagtcgttgcgctggaaacccgcagtcatccggtcaagctccgtaaaccctgttggaattcccgtgatatcaccttttcgattgtgaagctgttcgatattatcataggtctggacaaggacgtccttaatattttggaaggcactcgtgtttttgcgctgtgccacttccataatcgttttttccgcttcactgagtaaatcctcgacctcatcctcacgggtatacccgtcttgagcaatcgttgtcgcagttctgattaatcggcgaagaatcgatttttcctcaacgattttcgcgtaatattctatgttagccgctgtcggcaccgagtttgcgatatctgtcaaatatgaaataccgcctacttcttccagcaggtctgtgttcgcaagctctgatgtaactgtcaccagatcaaccggttcacctcggtcaccgagcaccagcatcgcattatagattttttggtgggacattctatagaaatcatctggaatcaatacttctgaagccagtgttaaagcagacggctgtaaaaaaatagcgcctaacacggcttgttcggcttctatattttgcggaggaagccggtcattcagaaggtctgtcatgctaagcaccgtcctctcattaaaaaatctccaacctccattctaccatttctacagaaaaaaaatagaaaaattgtctgtttcctgtttttttcagttagcagattggatcgtttcggacagtaacaaggcgggaaaaatgcaataaaacataagggaggaatgaaagatgataaagaaatatgcgattacacctaatgttgatgcggacggctggtttattgaggtggagaatgtagcgccgacagctttgtatacgtctaaagacgccgctattgaaaaggccaaacaggtggctaaggaaaacagtccgtctaagcttgtaatttatgaccagtttaaaaatgtggaagaagaacactcattttaatgaatgaaagccttcgctgcagcgagggttttttagcggttatcggtttatttcatccattggatgcctatgtgcatcatcaaatctgccgctttttgatacagatcccactccccgatcgaagcaaatttccccatcagctcctgaagctttaacctcattgctatatattcttcgaaagtgacagctttttcagtgtctatttggtgttccttcagcatttgttttaataaggataacggtgcgtgcataagaaccctccttacctcttttataacggtcattttccgattgctctattcctttgtgacatcttcttacatttcacatctgattcttgtacaatggacagaagagaggagggatcttttgtgagacctttgcaaatttctgccgaaactgcacaaaagcttgcagagtccttgaatctgccgcttgaacagatcatgcatatgcctcagcatattctgcttgccaaaatggctgaactgcaaaaagaggacaaatcatagccttcattcacatacttgcttacctgtttcgggataatatcatgtatatgttagaaaagaggagtaactgctttgccacatccacataataaaaaaatccaatcattttggctgatcaccggcattatctttatcgcctttaacttacggcccgcgatcacttcagtcggtccggtcatcagctctatccgggcagagctgcacatgtccaatggggcagccggttttttgaccgcactgccgctgctttcgtttgcagttctttctccgcttgcacctaagcttggacagcgcctcggtaatgagcgaactttatggctaggtctcgtgatactgctgatcggtgttctgactcgttctaccggctatactgccgctttgtttttcggaacagcacttatcggcgtcgggattgcgattggtaacgtacttttgccaagcttaatcaaacataaataccctgaaaagccagggatcatgatcagcctgtatacgacatcaatgaatatattcgcagctttagcatcgggtgtcagcgttcctttagcgacccagatgaatggcggatggaaacaagcctttctcttatgaggcgggctggctttacttgcattgctaatctggatacctcagctgcgccatcgagatacggcaaaccagacaatgaagctgcaatccagttccatttgggcttccaaaatggcatggtatgtcaccatctttatgggcctgcaatcgtttttattttacagcagcatcgcttggtttcctgaaattctccgttcacacgggattgatacggcaacagccggatggatggtatcactcatgcaatttgcgagtctgccttccacttttctgacgccagttttagctgaccgtgtgaaacagcagcgcggtatcgttgcggcgctggcctcagtttatctgatcggcctttgcggattattagcgggcggaagccatacattgcttgccatctggatgatcattatcggtatcggacaaggctccagcattagtctggcccttactttgattggtctccgcagtgaaaatgcccaacaggccgctgcgctgtcaggcatgtctcagtcattcggctacctgctggcagcagtcgggccaatctttgtcggctatctctttgaccagacgcattcttggacgatgccgattgtgcttctcattgctgccctgatcgtaacgggagcagccggacagggagccggacgagatcgatacattttccagtcagaaaaacaaagaaattcagcataaagcggggaagatatctccgcttttttctttgaatatttatggtttattcataagtttttcatatttgttttttacaatgagacaccataaagaggtgaaaaacgatgaaaaccaaacgattcgacgcagcccttattcttattttgctagcagcagcttttttgaatacgtatcacatttggcaggatgatacagcaaaccagtactatttggcggctgtaaaaagcatgacgcaaagcttccataactttttttatgcgtcatttgacccttctggatttgtgacagtagataagcctcctgtcgtgttatggattcaaacgattttcgcactgattttcggtgttcacacgtggagtgtcatcattccccaggctcttgccggagttggatctgtcttccttctctacagaatggttaagccgacttttggagttggagcggcccgcattgccgcacttgtcatggcactgacccctatcgcagtagctgtcagccggacaaacaatatcgacagcatgcttgtttttaccttattgctcggttcaacttgtctgcttagggcagtaaaacaaggcaagctggtttggctgctgacggcatttgccctgattgggctcgcctttaatatgaagatgatgcaagcgtttatggtattgcctgcatttgtgttattctacctgattgcatctcgggtttctctgaagaaaaaaatcgggtccctgcttctgtctcttgtccttctgacaggcctttcactctcatgggcgattgcagtggattcagcctcttcctcaagccggccttatgtaggaagcagccagactaactcagtgctagaactggcctttggctacaacggcacagagcgtctgtttgggcaaactacgggccttgcaaagggtgatatgaatgctgctggcggagggaacatgcagaatcaagacaacatgcaagcgccaaatggcaacggttcatctttttctcagaacggaaatcaatcattcggaaaccattcacaggcgcctcagccgcctaacggacaaatcggcgctctcaatggaggcggaggcacacctcccacaggtggcaacggacctggaaatggagggcctggcggtggaggcggaaaaagcgtgaatatgttcggcaccggtgatcctggaccgcttcgtcttttccaatcagcactttccggccaaatcagctggatgcttccattctcattgatcggattactgggcgcaatcgtcagctggtaccgtgatcgccgcggacatgctgctaaaatgaaagaaacgctattctgggcggcttggcttgttcccgtggctggtttcttcagcatcgcaggattcttccaccagtattatttgattatgctggcaccgccgattgccgccctttctggtatcggatggtatacgatgcaccgcttatacaaaaataataaagactggtccagctatcttctgccggcagccgtcttgatcacagccgtgtttcagatgtatattctgagcgcttatacaagccaaatcggcagtgtatggatgtatgtcctggggctcttaggactgggcatcacccttgcacttctgatgcttaaacgcagccatccgttcagtaagctgctgaccatcatcagcttgtgcgttctgcttctcacaccagtttactggtcagcaacgccgcttctatacggtggcaacagcgtccttcctgaatccggcccgcagctcaaaggctcagcaaacggcgggaacatgttctcttcagaggtcgacagcgggctcctgtcctatctgagaaaacacaataccggcgaagagtatttatttgctactttgacaaccgtaacagctgcgccatacatcatttacgaaaatgaatctgttatggcaatgggcgggtttaacggcacggatcccattctgactgtgtcggaactgaaaaaactgatcaaagaaggcaaagtgaaatacttccttctgtcagaaaacaactcaggcaacagcgaacttgtttcctggattaagaaaaacggaaaagaaataacatctgacgggtacagcggttcctccagcagcacaaacagcgtgcagggaatgcgaagaggacctggcggagaaagccagcaaactctttatctcgtggaataaaaaaagaggcttggatgaatccaagcctcttttctattaagcttcttcttttacatgtacctttaacacagcctgcacttcaggatgcagcttcacaggcacgtttgtatatcctaatgcacgaatgccgtccggcagttcaagcttccgcttatctactttaatgttatggtctttttggagctgttcagtgatttgcttgcttgtcactgaaccaaataaacggccgccctcacctgattttgcgctaagctcaacagtcagtttttctaatgtctctttcaagctcttagcctgctcaagctcagcaatggcttcttttttctctttctgcttttgtccgtttaacgcgctgatgtttgacacgttcgcttcaaccgcgaggccttttttaattagaaagttatgcgcataaccgtctgctacgtttttgacttcgcctttttttccttttccttttacatcttgtaagaaaataaccttcatctctgtacgcctccctcaaaatactcatctatggcgtgcttcagccgttccagcgcttcagaaactgaaatgccggacaactgagtcgccgcatttgttaaatgccctccgccttccagggcctccatgatgatctgaacatttacctcgccaagcgaccgagcactgatacaaaccgtttgttcatcccgtctcgccaccgcaaatgaagcctcaacctcactcatcgatagcagcgaatcggcagcctgcgcaatcagcacttgatcgaagtattcctcttcattttcaggaagagaagcaatcgcaatgttatctttatagaggaccgtatgctggatcagctttgcccgtttaatataggaatcaacggtttctttcaggaacttctgcaccagcaccgtgtcggcgccttttgcccttaaataagaagccgcatcaaaagtccgcgagcccgtgcggagagaaaagctctttgtatccactattataccagctaatagggctgttgcttcaatcatattgatttttaagcgcttcggctgatattcaagcagctctgtcaccaattccgctgtggaagaagcgtatggttccatataaacgagcagcggatctctgataaactcctcacctctgcggtgatggtcgatgaccacgatatgttcaattttattgaccagccgttcctccatgacgagtgacggcttatgtgtatcaacgatcacaagcagtgtgtcatcattggaaatttccattgcttcttcaggcgtaataaatcttgaccacagttcttcatattttttgatttccccaatcaaacgctgcacacttgatccgatttgatttgggtcaatcacgataaaaccatctttgttatttgcctgagccacctttaaaatcccgatcgctgcgccgatggaatccatgtcggggaatttatgccccatgataatcacattgctgctttcggtgacgatttcctttaaggcgtgagaaatcacgcgggcccgcacccttgttcgtttctccattgggtttgttttaccgccgtaaaacttcaccttgccgtttggcagcttaatggctacctggtctccgccgcgtcccagtgctaagtccaagctggattgcgccaaatcgccaagttctttcagggaagagactgaagccccgacaccaacgcttaacgtcagcgctacaccgtcaaatgaggttttttcccgcacttcatcaagaatcgaaaacttcgaattttcgagttcagttaagatgtgttcattaagtacagcgataaagcgttctgaagacgtccttttcaagaagatcccgtactcctgcgcccaagcgttcagcaaagatgtcacctggctgttcatcgtgcttctcgtctggtcatccaatccttgtgtcacatcatcatagttatcaaggaaaatatatgccaggacggttctttcgttttcatatagcttttcaatctgaatttgttctgttacatcaaagaaatataagagacgctcatcccgtttgatgacaaccctaaacttgcggtcattcaatgtaaccgtttccgattccacctcttgtttgataagcggcactaccgattcacaagtatcgtaaagtgatctccccactaaagtgctttcattaaagcaagaggaaagaaacggatttgcccattctatataatattggtcattaaaaagcatgattccaatcggcatttccatcaatgcctcttcaccgacttttttcaacctgtaggacaacgtagaaatataagcatcaatctcttgtcgaataagagaatcagcacgcttaataaaaaacaaaataactgccagcagcagcacttcgacggttcctaatatccagttaaaataaaagctgatgaggattgtaataattgacagagcaatcaatgcatagatgggataccgaaacagcggtttttcataaaagcttggcatttctatcactccccaccatgtgagtaaaactcatgttcacttcaccttattccttatatgaaagcccatatctaaaacgcctaaaatgcgaatggctgccatgaagaccggatgcacaaacccaagtatgacagcaatcacagccgcagcctttggatattgtttcttatggcaatagaaaaagataaatgataaaccttggatgaaaatcagaaacccgagtataaactccccatttaaagcgatagagtacagcatttggcctttttctaaaggcaaaaatgaaagcatgacaataatcaaatacagtactacaacactttgcggaaacttcaactctctaaaaggctttagattaggaatatcgggggagaatcgccttaagagcggcttagcgataaggtaactgaggaaagaaaaaataactcctaccatcacaatagctgttggaaaaagatattgaacgatacccaattgttcttccatcagttttaattgcttctcaaactgcccagcattgcccgactgcttcgctacagtttctacaatatcaagagattgccggtattgtgtcattgcctcatcaatgatattgatacccaaaaactgaatgcttatcacaaaatagaagacaatactaagcatataaataagagcgcccgaaataatggcgtgcccgggctctttccttttgaaaaaatgtcccatggcaatgccggcgcaagctgacataaaagctacaataagcccgttaaaggacccgacaataaaaacaaccggaagactgacagcgcccatccatatccctagcttcaatccatgtctgatcgtatacaagatcattggcagcggcagtgcaaataacagaattgttccaatcacaggaacataaacgaccagaagcgtaatgatcgcaaacagactgattaaaatagcaccttccattaaagctctcgtttgtttcacttagtcacctcgtatcatcctgaacatacgaatagaaaagagcagcataaacgactgctctttttttcatcgctgcaacatgctttgcaccgaatgtttttatatcatctctaaattttacttttatattttaacataagtccaaatcgcaagtaaaatgacgctaatgtttcatgtgaaacatgaaaaaggaaaagacattctttgaaaagaatgcccatcacaattaatgtttatcatccataaagccagaagattccttgtttttctttttcgtttttctgacatacataaaaattaaaatcaccagtaaaagggttgttgcttgcagaacgccgctgctaaacaagaaaaagttctttatcatgtcccacattgtgtttcacctctttgtgcatgttctcaacccgtatcctatataaggtgaatttcccttttaaaaacttcaaaacatcatgaacaacattgagcgttgggcatatgctgatatggaatctgatcgataaaggagaattttcacatggatgaacgcagaacattggcttggcatgaaacattagaaatgcacgagctggttgcttttcaatcaaacggactcattaaactgaagaaaatgataagagaagtaaaagaccctcagctcagacagctttataacgtgtctattcagggtgttgagcaaaatttgagagagcttcttccgttctttccacaggctccgcacagagaggatgaggaagaagaacgcgcagataacccattttacagcggtgacctgctcggttttgccaaaacatctgtccgcagctatgccatcgcaattacagaaacagcaacacctcaattaagaaacgtactggtcaaacagctgaatgctgccatccagctgcacgcccaagtttatcgatacatgtatcagcatggatattatccgtcttacaacctttctgaactgttgaaaaacgatgtcagaaacgccaacagagccatttcaatgaaataaaacaagcagcaaaggagttccctttgctgctatttctgctgatccttcactaagccgttcgaacgataagattccagcacgtctctgttggattctccccattctttcatttgcaaaacaatcggttcaagcgtgcgcccaaattccgtcagagagtactctaccttgggcggcacctggtgataaacctcacggtgcacgatgccatccgcttccagctccctcagctggagagtaagcattctttgagtaatactcgggcagattcgccgaaactcattaaatcgtttcttgccatctatcatgtgataaaaaagaattcctttccactttccgccaatgacatctagagtgaattcaactggacagccttctttgttcgggtatatattctttttttcactcattcttgaccctccaatagtaccttttttgatactacattacattttgcaactaagctacccagtattttatacaccttttcttctcagctcaaagaaaatgcttcttattcacatcaatttttaagggtttgcatgattacacctgcagcaagacgtgttaaactatataaagattacactacttaaaaaaggataggagctatcatggaaaagatacttattttcggacaccaaaacccagatacagatacgatttgttctgcgattgcttatgctgatttgaaaaacaaactcggcttcaatgctgagcctgtccgcctcggacaagtcaacggcgaaacacaatacgcgcttgactatttcaaacaagaaagcccgcgtcttgttgaaacagctgcaaacgaagtaaacggcgttatcctggttgaccataacgaacgccagcaaagcatcaaagacattgaagaggttcaggttttagaggttatcgaccatcaccgcatcgctaactttgaaacagctgagccgctttactatcgtgctgagcctgtaggctgtacggctaccatcttaaacaaaatgtacaaagagaataacgtgaaaatcgagaaagaaattgccggccttatgctgtctgcgatcatttctgattccctgttatttaaatctccaacttgcacggaccaagacgtagcagcagcaaaagagcttgcggagatcgctggcgtagatgctgaagaatacggcttgaacatgttgaaagcaggcgctgatctaagcaaaaaaacagtggaagagctcatttctcttgatgcgaaagaatttacgctcggcagcaagaaagtcgaaatcgcacaagtaaacacagtggacattgaagatgtgaaaaaacgccaagctgaattagaagctgtgatctcaaaagttgtggcagagaagaatcttgatctgttccttctcgttatcacagatatcttagaaaatgattcacttgctcttgcaatcggtaacgaagcagcgaaagtggaaaaagcgttcaacgttacattagaaaacaacacagccctcttaaaaggcgttgtttcccgtaaaaaacaagtcgttcctgtcttaacagacgcaatggctgaataagcaaaaagcatcccgcgtcgggatgctttttcttattcacccagcttctcaatttgtcccatcacatcagtaatttgctttgcgttttggaccaggtctgactgctccaattctttaagcgataccttgccttcctcggcttgtttcaacacatcttcagcgcttttctgcaaggttttgttatgttcctgaatggtttgatgaatctccgctgcggcatcaggcggcgttaattcattaaaatcagcggcagccttctgaatcgactcaagctgcgcttcaagtttttctttcgcctcggtgtcatttacagctttctcagccaattcaggcgcttcctctgcaaatgtcttcaccttctccacataaccagctgcttcactcgtatagttcaatccgtcgttcacctgatcaagcatgccgcatccgcctgcactcaaaagtcccactccggcaagtactgtcaaaatgatcttcatcttcagcccctcatcgtttctttttcattttttcttttaagatcggaatcaatttctctttcgctaacggcagccctttcctcaccaattcacgcttcagccactttttcagcttagacattctgatgctcctctccctttttgataaaaatgaaaaaactccaccaatttggtgaagttcctgaaacaaaaagaccttcaccaaatcagatttggcaaaggtctcgctaacaatgagattgccagcaaagccgaggacaccttgtcccgtaatgacgactttactgtgaaagctactcccctttggagtgttcatttttattactttcattctaaagcaccgatctgttccagtcaaattcctgccgtttatataaaagcgcgctgtggtatttaaaatttgaatggtttttctatcaggagatcatgctatgacagaggaggttttcatcatgagtcaagagcgcgtgaaacggcctgggcataccagatggtacatatcttcgttacttagcggcattattattcttaattattttgaccgagtggccatctcggtagcggcccctgcgatacaagattcgtttcaccttactgcaactgaactcggcatcgtgttttccatttacacctattcctatacactgatgcagctgcctgtcggaagtttgctggaccgttttggggtcgcatgggtcacgagggttggaatgacaatatggagctttttaacgatccttcttgcttttttgcaaggaaaattgctgttgtatctgttccggtttctcattgggctgacgagcgcctctgcgttccccgctgcctctaaagcaaccgctctctggtttcctccaagtgagcggggattggcaaactcattgttcgattcggccgccaagttttcaaatgtaatcggcgcgccattggtcgcctttcttgtcacaacatttgactggcgtgtcgcttttttgacgattggatgcatcaatgtgctgtttacgatttttttctggcagtattatgaacagcctgaacggcataaacgtatttctaaaagtgaactaaactatattcaaaaacacaatgccattacaacagagcaaattccttacaaaacgggcccgcttttaaaaaagcttttcaccaatcgaaaagtatggggcttaatgatcggatttacagggtacgggtatacattcaacctgctgctcacctggcttccgattttctttaaacatacatacggtatggatctcatgtcgtccggtttatttacagcagtgccgtggctgatctcaaccatttccggaattgccgtcggcggctggctcgtcgattattttattaagaaaggctatcctaacaccaaggtgtaccgaaccgtaatcatagtcggaatgagctttggctttttctttttaggatccattctgacgaacaatattaccgtagccattatttgcatttccatcggactcgccggaatttccgcaaccgctccagtcggctggtccatctccgcagaactcgcgccgatcggttccgtatccatgctgagctccatggtgaatctcgcaaacaacctgttcggaggcattattgctgcgtcactgacaggatatttgtttgatgtgacaggctcctttaccctcagctttctggtagctggttttgtgctgttgctgggattggttttttatgtgtttgtattaggggatgtaaaacgaattaaactggaataaagagtgcttgctgaaaagcactcttttctttgaatccgccaggtgttattttctttctcccacattcactaggctgttctcggatgaaaacaccacgattttatccttgactccaaccaaaggtaaggcctcatagtgaaagaagaaaggaggagtcggatggtgaaattaacagtaaaagaactatccaatattgcgaatgtcacaatcaaaacgctttatcattaccacaaaatcggcttgctggccccaaaggaaataagcgaagccggatatcggtactatggtgctgacgaactaaaaagactgcaggaaatccttttttacaaagaattagatattcctttgtcagaaatcaaaacattactaaaagaggatgctgaaagaacaagtacattagaaaaacaaaaaaagctgtttgaaaagaaaattgaaaagtatcagcgtctcattcaaacagtcaacacatctttagaatacacgagaaaaggcgaaaacatggatcataaggtaatgtttaaaggatttgaaagcgctgaagaatggaaacaatctttagcagaacaaaatgggtatttaaaagagcgttacgattttgaattggatacacatacaatcaatgtcaatgaaatgaacaaaatggcaatagaggctaaacattttcttgataggatggctgatttttcaagaaacggtgtaacgtatcatgatccttccgtgcaagggcatgtcatgaatcatcttaagttcctaaatcagaacgggcatccgacaagtaaagaagattacgtaaaacaaacacgtttttttatgcaagatgatttccatagaggaatgttagaagagcagcaagccggtttatcttattatttggttgtcgttgcagaacacctgtagtgttttgtcaccctttatagggtgacagccatcaggattacgagacagcaccgccaacaatcgaaacattctgccggtcaacgacaaaacgccgtccgttccattttaatacggtttgaacatatcccaatgagtcggcgttataccttcccgctatccgctggtacgccaataattcgtatacgccgtctctgtcaaaatcaaccggatacaagcccgataaaggattcacccatccttctatcggcatttttaacacaccttggctgttataaatctcattcaaatattccctgcccttgtaagtaaggtcgaggatatacgtttcgttttgctgatgactgatgacgctcgctttatattgattttgatacctcacactgtactttaattcatcattcaatacatctgaattgaaaattcgccggaactgcctgtttagataggcaaacacatatgcataaatagcaccgccacttcccctgtatccattaccactgccacatcctcaatcttgtcgcctgtcatatcccccagaaaaagtgacggattgtatcccatattgttttgaagctgaatccgctgctcctgatgggttctgccatcacggatcaccaatgtgatatttctccataacgggctgccgggcatttgatttccagttagaaagacctcgtcaataacgccgtctcccgttacatcgccgcgagtagatgcaatgattgcacgtgaggagacaggctgccgaaatacgtatggatgttgaacaagtcctctgctttcataaaaccaataaggagccattctgatgtcatacacattcaattgtgtcaccttccctaatcagctgaatgaatcattatatgcaggaatggcacatcaaagacatatcttacacaccaattaaatccgtaccatatgagttatcgattacacaaagccactcgcctagcgcattcttcttaaatacaaaggtcgcccttctttccatcgcatactcggagtcctttttatccgaatcaagcagtgtctgagaaaggacgagtaccgtgtcacctgcttccaggaggatcatttccccttgtctcggcacaatatgatgattgaaatagttcgcaatcgtgataaacgcttttttgatttcttctttgcctcgcgcgatcatgcccggcttcacaactaacacggcatcttccgaataataattcatcagtgtatcaaaatcttcattttggattgccaaatcacacgcagagatgatgtctttcaattgctgttccaaatgaattcccccaatcatcatgattggatatattatacattgctagaccactgaaaccgtgaaaacaaaatgaaaagtatccttttttcctatataatcaaatagatatatttaacaaagtacccaagtgaaggggtgaacattattgtctgcggaagtaacgttacatgacaatatacatcatgatttaagtgcggattgccagcactgttttggcctgtgctgtgtcgccttgccttatgcgaagtcggcagattttgcttttgataaagacgggggcacgccttgccgcaacttacaatcaaactatcaatgttctatacataaagatctcagagaaaaaggatttcgaggctgctctgcatatgaatgctttggcgccggccaaaaagtatcccaaatcacttatgagggaaaggattggcgaagcagccccgaaacggccaaccagatgtttgacgtttttcctatcatgcagcagctgcacgaaatgctctggtatttacatgaagctctttctatagatatagccaagccgattcatcccgaactgagaaccagtttcgaaaaaatagaaaagctcaccagactcagcaaagaacgcctgctgacactgcaggtggacgagcatcgagctgaggtcaatgaatggctgttaaaaacaagtgagctggtgcgtgcccaagcccgccatccaaaactcccgaaaaaggtcagccgaggaagtgtcctgatcggcgcgaaactgaaagggcttgatctgcgaggagcaaacctaagaggggcgctgctcatagccgccgatctgagaaatgccgatttgagaatgacagactttatcggtgcagatatgagagacgctgatctcagcggcgccgacctgaccgggagcatctttctgacacaggcacaggtgaacgccgccaacggcgattcgaacacaaagctgccgctgtctttacgaatccctgcccattgggaataaaaaaggacccgttaacggtccttttttactgatcaattcaatcctttttcgttccttttatccggcactttcgcacttcttgccaagtatcccgacagccataacgcaaccagcagcatgaaggtgatcataccgacaacgcccagccagtgaaaagcagaccagaatagccctccgattgttccgaaaacacttgaaccggcgtaataaaagaacaaatacagcgatgaagcctgtgctttgttatgaagggctctcctgcccacccagctgctggcaactgaatgtcctccgaaaaaaccgaatgtaaagagggcaatccccagaattttcactgccagcatactgtttatggtgaataaagcacctgcaatgacgatgaaaatattcatcaccagtatttttggatagccatattgatcaaccattcttccaatgaaagacgagctgaaaatgcctacaatcatcacaataaatatccagctggcaaatgctttattaagcgaatacggcgggcccaacagcacatacacaatgtaattaaacaatgcaacattgcttccgagcagcaaaaaaccaatgagaaacaagctgaatagtttacggtccctcaagtggccgatcagagacattcccaatttcccgagcttcaattttcttggcgtaaaatgcctggatggcggcaaattcataaaaaatataatactagcaatcaaactaatgacaccaattgcccccatcgccatatgccaattcaagtactcgctcaggagcccggaaacgatccttccgaaaacggcgccgattgcatttccactgatatatagccccatcgctgatccaagacttccgggttcaatttcttccccaagataagccatcgcaatcgacggaaggcctgcgagcgcaacgccttgaacggttctcaatacgagcagtgtatgaaagttcggactgaaggccgatgccagacagagaaccgatgcggccagcatggaaatacccataatcggcttgcgcccccacacctcggataatgaaccaaagacaagcatgctcacagctaacagcattgtggtaacagataaagaaagactcgccgcagtaggcgttacatgaaattcccgcgtgaattcctccatgagcggctgtacgcaatatagaatcgcaaatgtattgaaacccgcagcgaagaaagcaaacgtaatttttcgaaaaaccggtgtgcctttttgaatgtatgtcatcgagactttatcggtccctcatcaagttgtggagcactgccattcataaacaatcatcctttatttcttccgaattcaaacatcctcgagtctgtttatattactatcttagcaccgttgatatatgttgtataatgcatataaaatatcattttcatgcttatatgtaataaaggagggatgataattggaatgggaacaacttgaatattttcaaacactggcccgaatgcagcacgtcacgaaagccgcaaaaagcctctccatcacacagcctgcgctttcacgctctatcgccaggctggaaaatcatttgggtgtgccgctatttgacaggcaaggacgatccatcagcttaaatcaatacggacacatttttttgcggcgggttcaggcgatgatgaaggagtacactgaaggaaaagaagaaatccaagctttattaaagccagaccaaggcatagtctctctcggttttttacatacattaggcaccacgctcgtgcccgatctcatcggctcctttcagcaggaataccccaacattgccttccagctgaagcaaaaccactcttattggctgcttgaacgattaaaatccggggatctggacctctgtctcctcgcttcgattaagcctgaagatccgatccaatggatcaagctgtggagtgaagaactctttgtatttgtgccaaatgatcacccattagccagtcgcgaaagcattaccctgaatgagattgccggggagcgttttattttattgaaaaaaggctacgcgcttcggatgacggtcgatgagctgtttgagaaggccaatatacagccgaacattatgtttgaaggagaagaagcagctactgccgcaggttttgtggcagccggtctgggcatatctattcttccagacctgaaaggcttagaccaaagcaaaatcaccaaaatccgcgtcagctggccggaatgtcagcgtgtcataggaattgcctggataaaaggcaggtttttatcaccggttgctgagacctttaaacaatatgtgatcagccatttttctgagtagggaggatagcatgaatatcaaaaaaatcacgtcagaacaggatttacatacagcgtttgaaatcagaaaggcagtatttgtagaggaacaaggctgtcccatttcggatgaattcgatgagtttgatacactccacggtgattgccagcacatcctggcttatcatcagaatgtacctgttggcactgcacgtgtccgtatcgttggccacacggggaaactggaacgaatctgcattctgaggccttaccgcaaattcggtttgggaaaagtgatcgtcggtgcattagaacgtattgtgaaagaacaaggcatttctgccttcaaactgcacggccagacacaggcggcaggcttttatgaaaagctcggttatcagactgcatcagaagaatttatgctggatggcattccgcatgtgctgatgacaaaacaagacgattctgcgctatagattgttcacaaatttgtcacttatgagcatgaacagttcattggtatactaatcaccgattatgaagagaaggaatgattgtatgccagcaaataaaaaagagagtcttatatttggcgtgatgatgtgttttggaatggtctgcgtcatgtcgatttacaatgccatcatcaacggagccattcaggatttttcactgatgaccgtttttgaaatggtcatcggttttatgctcgccctcctgttagatttactgttagtgggccccctcgccaagaagattgcattccgcatgccgttcgacaagactaaaaaatttatgtcatccttgccatgtcaacttgtatggtgattggcatggtactttgtatgtctgtgttcggtttagtgacagcggttctagcaaatgggctgaacgaggacagcctcttcagtgcttatcttatgattgtgttgaaaaatttcatcctggcctatccattgcaattactgattatggcccattagtcagagggattttcatgaaatttgtaaaaccaaagctcacagtcgcaatttaaatagaaaaggagtgagcctgacactcactccttttgctcatgaatcggatgtaaaacaagctccgcaaaagcctctgcggcaggcagctcccattttttctttttgagtaataggtgtgagtaaatcggatcgagagctgcaccatgctgaagaattttcagcttatgtttttcacttccattaatccctataccttaccacatagtttttatacaattcttcgttataaagtatttcttcgccatgtgaagagcaaatgagcgttggtttgatttgatctatgattgagccgctatcgatgttctcatttatatcaacactgaatcttcttataggtgggtgtaaatcctccttacttgtgataaaaaggtcgcccgttaatagcgtacgatcgattttatgataatacacgacatgccccggcgaatggccaggtgttaaatagtatttcagaggcaggtgagaaagcgtttgctccgtcagcggctggacaatatgggctacccctgtgttctccacttcatttttgttcggatatggctcttccccattgatgtactttagttctttctggtgcgcaaaaatcggaatatcaaatctctctaaccattttgatgcacctccgatatgatcactgtggccatgggtaagcaaaatggcttttggattgccgatcgctaacgctgccctaatttgagcatcagcaaaacgttctattcccgtatcaacaatataaacatcatcaccatctttgataaaccaggtatgaaccggaatacgaagaggcacatcaagctcaaattcacattgatagacatgttctgatagttgtctcaagttcacgcaaaccactccctttggagatttttgatagttcaaaagaaaacagaagtgaacggccagcggactggaattcttgaggaggagacgccgattttcgccagcatcagctcgacttgttaacattgtccattaataatcccttttgttccccttcttcacatattcccaatcacgttctatattcttcctcactctatgaaggagtgcagaaatggtttccttttcctctgaagtaaaaccggacaaggccacttccgtggaatgttctccttctcttcttaacaatggatatacctttttccctttctcagtcgggaacagtttttttatttttttattttgctcatccggcagtttttgaataaatccctgcatttccagcttcttaatggcccgcgcggccgttgtccggtccacttttatcatttccgccaatttttcttgaataattcccggattttcgtatatacgtacgagatagagatactgccctcttgttaagtccaaatctttaaattcgatgttgcttatggaatccaacgctcttgctatcatgccgatctcacgcaaaatatcattcattcctaaaacccctcacgtatttttgttgcatttacaacaaaaatgttttaaccttactattataagaccacatgcatgctgtacagtccagactaatatcagaaaaggattgattcataatgaatttaaaaagaataacaactgaagctgatttacatgcagctttgaatattagaaagacggttttcattgaggagcaacatgtatctgaatccgaagagtttgatgaatttgatacgctccaggaacaatgccagcatgtcttggtatatcatgagaatcagcctgtcggcacgggccgtgtgcgcatcgttgaccatacagcaaagctggaaagaatctgcatcctaaaaccttaccgtaagtatggattggggaaagtcatcgtaagcgggttagaagaaatcataaaagaaaaaggactgactgcatgtaagttgcatggtcaaacacaagcagcaggtttttatcaaaaactgggctaccagatttcttcacaggcatttatggaagacggcatctctcatgtcttgatgacaaaagacatatcgcggaatataacatgaaatatattttttacggattaggcatactcatattaagtttgggcatttccttaaccatacaatcagggctgggcacatccccttcgatgcccttttggttggtctgtcaaaagaagtcggacttaccgtaggaagctgggaggtccttatttctgtgatcctcttaatctgcaacgctatattaacgagaaaaaaacctattttgctgggcttgattacagcattcattactggaataggcattgacctatggttgtttgttgtaaaaaacaccctctatctaaatgcgttgttaagcaaactgatttgtttcggaattggtttggtgctcatcggtcttggaacagccatctatcttcagacaaaattcgcatcaacacccatcgatcatttaacacttattatccgagatctctccaaaagaacaatcttgttttcaagaacattggtatacgctcttttcttagtattagccatcgtctttaaaggccctatcggcatcggaaccctattaaccgtctgtttgggaggaatgctccttcacgtttttatacctattgtggaaagacaattcttatcaaagaatagaaggggttaaaaaacctcttctttgaaaaaacgaaacgcaaaacaagctacgtttcgttcaataattttatgataaattaaaatttatagtaccaaaaaatcgcaatttcatttgctgttggaagattggaataaagcatcgaatcaactgcacctattataaagtgatgtttggcataaaaacgacaagctgaaacattaatatcttgtgtttcaagcataaggccacaaaatttattctcctttgcccactcaatcgctttatgtaataatgctgttccaacgcctttttttctatagtcttttgcaacggcaatgtcctctattagtgcatacccattccagttagaacgaatcttaatccggccgatgcagttgttttcaacataatataaaaaaaccgcttttccctcttcttcaacataactaacatccatttcatcatcttcatattgtttaaaataaggtttagaaaatcgttcctcagtatatgtccaaacaccgttttcaaaagcaggtatcattctcccaaaaacaacgaaaggttcatttggtttattgaaatctttcaaattcaatttagtcattttaatgatcatatcaatctccgccaatcgaaataatatttagtaaactcgtttcgatactattcaataacagcttccaaaagtgcactttttaggagaacaacactaggtaagacatccattaccttatatatatttcactatcttattgaggtatttcaacagaggcttgtggtacagtaaaaatgcccactaacaataaactcaatgagaaatatcatacttccttcaactcgcccacaaccctgttgactagtatccgtggagagaggaagctttgacacagcttctgccaatggtgacatctctattgaagtatccaaaggacaaccaaggatcgctctttgactttttcaagaagaaagtagagcgaataaaggagtgattgagtatgttaacaagagaagatatctttaaacacgtcaaagaaaaatacggtacatcgcctgattacccgtgggagaaatacccaaactatgcttctttgagacatacatcaaacaaaaaatggtacggtcttatcatgaatgttctcccagaaaaattaggcttggatggtcatggcgaaatagatattctaaatctaaaatgtccccctgaaataagtgatagcttaagaaacggggaaaatatcttacccggatatcatatggataaggaacattggatttcaattgttttagaacggacagatccagaaggcgaaatctataacttaatcgagcagagctttcatttaaccaagtgaagataaagagtgttcctgctaatcgagctgcggagagtagtgggcactttcattttaggatactgttcttcactctgtccacaaacgcaacttagttcatctggtgcgagagtgggagaagaatttcaaccaacttcttatgtaaaaggatgaatagttatgacaaataacttaaaacagagaagaatcattttagatttagcagttactttagatggttttattgaagggaaaaatggagaagttgattggtgtattatggaccctgatatggggtttactgattttttaaatcaaattgatactattttatatggtagaaaaagctacgatttatggggacaatacattccaaaaaatgaagaccctggtacagaaaaggaactttggaaattggttcatagtaaaaagaaatatgttttttccagaacacaaaatgagattgataatcaagccatatttataaatgataatattcttgaagaagtaaataaattgaagaaaaatcctggtaaagacatctggctatatggtggagcgagtctcattacaacttttataaatttggggcttgttgatgaatttagattatctattcaccctgttgttttgggagaaggaaaaccgttgtttattgatgtaaaacagaggataaatttaaaaatggtgaatacaagaacattttcctctggcgttgtgcaaatcgtttatcattggaatggctaacattgtaaagtaacactcgacagtaatccttcttattgaactaaaggggaatccataaataatgggttccccttaatatactatggaattatcaatatcaaattttctgtaataaaagaggattgaaaaggacgatgtctcctcaattaacatcattaagcattatagtatattttcttctccctcttttaagtaatcggctaagttttgtatttataaaaaaacgaaagaaggtgatccaatgcctactaacaataaacccaatagattaatcgctgagaaatctacttattttacttcaacatgctcataaccctgtggactggttcccttggggagaagaagcatatgaaaaagcgaaacgcgaaaacaagcctgttctggtcagcatcggtagttcgacatgtcattggtgccatgtctattagaataaccataatagatcttttatgactctatattatctatagttttataaacaatttgatctttcctaagtattattttcaaaccgaatttttattatctatctctcctacttatttttaatatcctgatacactttctcaaaagtctcgattggtagcgaaaacttagttgttttctcgttacgataattgatcactatatcaatttgattacctttttgctcaaactcaataaatgcattctcccatttatctctgattgatattatacgattgccatttttcttttccttatagatgtaatccattttaactctccttccagaatcaataacaaaaccttatgttattaaaagtctacattatcgaccgacaaaaggtttcgaaataagcaatcctcaaaaaaggaagtaaatcatgacttgcgtttggtggcccggataatcaaatcgtgtggaactccattaaaagataacaaaagccattttaaacgataatactatttgttcaaacaatacagtttaccttttatgtcattcattttctaaaaactgcaatccgtaaccatgcggtagcaggtttttttatttgcttgacttagagttaactctaaattgtaaactaactttaattaaatgagagggatgatgttgttgtattccattagtaaagctgctgagaagactagtattagttcgtatacattaagatattacgaaaagattgggttacttccaccaccaaaacgaaaaaacagtggaaggcgtttttatacggagactgatattcagttcatgttattcctgaaaagtttaaaggaaacaggtatgtctttggaggatattaatgagtttgtcaaagacggatgcattttggaaaaaatcaattcggatgttaaatcggcacaactctccccatctataaataaacgtattgagattttaaccaagcacttagagaaaatggaaattaaaaaaagggagctagaagaagtgatttctacgacaaaaggaaaactggatacatattattcaattttgaaagaggaagtggaaaacaaatgaaacatttaaatatatacctgatgttacttggcttctctatttttacaggagctacttttaatcttgcaaaatatacggttggatatttttctccatcgtcttctgcggcatggcgtttcggtttagctgctgcggtgatgctcatcattttgatttttactgaaggtataaagaagagtcaattacggaaaaacgccgtttcatacattgttcttggaattataggaatctttggatttaatgccttgtttttcgttggtttaaaatatacatctcccgttaacggagcattaataatggggctgaatcctttattaacagcaattctcgctcgaattatcttaaaggacaaaatgacaaaaaaacaagtactcggcatattctttgcattcatcggtgtattgttagtcattacacaaggttctatcgaaaccattaaaaccttatcaatttcaggaggagacttaataatctttacaggtaacgtttgttgggcactttatggcgtacttggacgtcggtttgtaaaggatggtacaccgctatctacaaccacttatacgatggttatcggtgctgttagtttaatagtagtttccttatttacatccaaacctgtttctttatcgaacatcccgattggagtttggggggcaattgcttttatggctttctttacaagtgttttgggttacctatggtggaatcaggggattaaagagattggggctagtaaaacatctttatttttcaaccttgttcccgttgtaacgatgattatttcatttgcctttggaacaccaataaaggtatttcaagttattggggctgtgttagttatattaggcgttttaaccgcttcgggggtaatacatattcctaagtacaatactaaagaacagtcagctatataaagaaatagggagtatttttgagaaaatgtgttaagttaaatatacactaattataggaagaaggtgatcccatgccaaacaaaagtaaacccaatagattaatcaatgagaaatcaccatacttactccaacacgcccacaaccctgtggactggtacccttggggagaagaagcatttgaaaaagcaacacgcgaaaacaagccggttctggtcagcatcggttattcgacatgtcattggtgccaagttcgtatagctacacacctataattatgataatctagaagtatattacatttttagtcataaagggtgatgggctgttggagttgaaaaacaaaatcaaacgagtagccatttatctaagaaagtcacgaaacaaagagggcgaagaaacagaagaaaccttggcaaaacatcgaaaaagacttcttgatattgctcataaaaacaattggcagtatgaaatattccaagaagttgggagttcaatggatgaaatgcgacctgaataccaaaggatgattagcaaactcacagatggtatatttgacgctgttttgtcagttaacttagcacgggttacaagggatgatgctgagacacctaaattcatgaaccttttacgccaagatgacatactctttgtcactgatagtgaaagagtatatgatcttgaagtacaagaggactggcaagcattaaaatttactgggttcgttaacaattgggagtacgagaatataaaagcccagttaagaaaaggaaaaaaggacagtgcaaaaatgggtcgctggtcaaatggcacccccaactacgggtatatttataaccgtttagaaagaaaattagaaattgatgaagaaaaagcaaaagctgtaaagcttgcatttcaaatgactattgatggcataggtgctgataatatcgcagtaaaactaaataaattggggtacagaacaaaaaatgggaagttttttcaaggtcaaagcattgtcagaatgattcgatccgagatatataaaggatggattgttgctaatcgattgaaaggaagaaataaaacacagggaaaaataagaccacaagatcagtggattgttgttaaagacgctgttaaaccctgcattatagacgaagatacatgggacaaagcaaacaaagctttagataaacgaaaattacttaatcctagagccaaaatgagaaaacacggattatcctctttaattgtatgcggtttttgcggaagaactcactcaattactatacgtaaagatagaaataacatgagagtaattcaatcatgtagaaaaagaaacccacttggtgaaaaatgtactaatggcggaatacaatataatacaatgatggaattgatcatcaataatataagaatgaaaaaggatcaaatacatttagaaatcgaaaagctaaaagatgaaaatgaaaccattgataagactgctattgagatacaaagcattgaacaacaaattaaaaaagtcgaaaaagcattacaaatgctccaacttcaattagaggaagacttaataagtctcaatgactttaaggagagaagaactatccgatcaattgaattggataatcttcaaaaagaactaactaaattaaaagaaacaacaaaagaagataaaataaaatccaaggaatcattcattgaatacttagatcattttctcgataattggtcagaattagatgagtcgcagcttaataatgaattgatgtcttttattaaaaagataatatggtaccatcctattggaaatagagaatatcgtgaaatcaaaattgattgggctgaataaaaaagaagtgaactttataaccgttcacttctcttttttattatgtctcaactctatcagctaatgtaaaaactttattattgtttgctaaatcaacactattcaatcctgctgtgctcaagcccagtatgactatcattgataaggctattaatttgagtttcactaatcatctctcctttttgaatctggtttttggctaagatcacttctttataatatttcgatgatcttgtagtatcaccttttttttgaaatacctctgccacttcaaaaccaaattcttcaatatctccatacattttatgtgatacgaaataagaaaatgaatcgtcaatcaaattataacatttatcagttaagtatagggccttaagcaagtctaatttaactatatattctgaattatttctctcttttgcaacttcatatcctttttcataaaaagatttagcagactttaaatcaccttttcttgcttgaacatgcgccaaattaaatagcgttttctccacacaagcatgatttactttgtcgaaatacttataagcctcaattaagcagtcataagctttttcatattcctccatatgattataacaaatacccatatttaatcttgaagtatatacgtgcatttcacttcttattgaatatgaaatctgaagtgtatctttaaattttgctaatgccccttcataatccaaagaatcaatcaaatttcctgcaatgatataattgcaacgcaatacacgatctgcatagttattatatttctgataaatccgcattgctcttttaacataattaagcgaaaaatatgtctgtttcatgtaataataaatttcagccattttataaaaaattcagcatgttctatttcatcatcaacatattcaagtgacttttcggcacgtctgtaggcacttatagcagaaaccaactcttttcttctaaaatcgtacatgcccataaagaaaaagaagtaataatcgagcataccttttaattgtccttgatgctctttaagagattcataagccgcctttaattcttcttcatttctcgatttaagataactgagcattaactcatgtctaaaatctaataactgatgatataaaatcacatcaggatttttttccatattgcccattaactcttccacttcatcttttaatctttctgcttctctatccaagttgtttttgattgctgtataccattcattaagtttctttgtaacaatgtcatatggaattttgtcttcattcaaggaaacttgttgcaagaaaattcccccatccttacataaattcacagaatttttacattaattgtattatgtcagatttaaattaagtatacaaagatgaattgcaaaagggtacattatatctactcctttgcggtttttttgcggttatagcaatacttttgcgacttgacgccaacatcacggcaaccctttcataaacacaaaaaaagaggagtaaacacatggtttactcctctaacttagtttctttaccttttgcttcttcataatctggtgttttccttgataagccaagtcgatcattttctccattccccggcatatcagtcatcttttcatatttatctcctaatttttcataatacttaaatgttgttaattcacgagaagagttatccggcatataaaatgcaaactgaatatatttgcccccttcatagactctaacaatcgcattctctcttttaatatttatctctgtgtcatttcctttatgctctttatattggctaattacatcatcaatcgcatcatcatacttgcttccaccacatgcagttaaaacaaacaccatcatcaaactaaggaaaataaaaaggtttttcaaaataaacattacctcctttttcaatatttagtataaacaaacaaattgatcttttccaccttttatccatttcccttaacctgcacattatcgactaaccaaccatccttttctttcttcatagtcgtttgtacaattaacacttgattcgtagtgactgaatttgcagttgtggcgacttcaacaatgtttaaaaacaattcatgagactcatctaacggctttgaataactctctagtgatagtaattcactttgcacgctgactgtgtgcttttgatcagagcgagaagggaatgcataatcaaacccttttccagttgtgtgcttcttaactgtttcatatcgtttatctatgtcggaataattaaaaaacgcttcaaaaaatgccttattttccgaagcgctacttgttgattctatatggttcaattccttaattttatcgctcaaaacttcatttttatcttttaacttttcaatcttatacgtttgctgtccattcgtaaaaaatccagtcagcaatatcaataataaacaagctgaagcccatgcaatatgtgttttcatgttttcactcctagttatttaatgcgtccaaaagatacaaggtgatctctccaataacctgatttcagatcagaatattcgattccactgtcatttgaattaaacattctgccattgcctacatagatgccgacgtgagtaatggcttttccttcgtatgtgccgccaaagaacactaagtcacccgcagtcgcttctttttcacttattttctttgttgccccatgttgttcttgtgctgttctaggaagagtgattccagctttcgcaaaagaccactgaacaaggcctgaacaatcaaatccagttttcgggtttgaacctccccaggcatacggttgcccttcatatttcaaagcttctttcatgaccgtttcatagaaatccatagagccattcacaggcttcacatttttatcagagcctttcacatacctcatgacatggtcaacataacttgggtcaccgtagcttttccagcccattttaaaagcttgcaatcggctgaaatcaagtgctaatttctttgtgtatttcccgccattctttttgacatagtctataaatccagaaccaaagttgtatgcctgtaaggttaaacgaacatcaccaccagcctgtttaaaaaccttcttaaaatgtttaatgccgacttcaatcgaacgttctgggtcagttatggagttgggaggtaagccgatactttcggaactttgcatgatatctaaagaacgcccaccactttcttgcatggtgagcgccataataatattcacttggtcaaaaacgccttcttgacgggcatatttctcaaatactgctctaaatcgttccacttccggcgcaattccaactgtttcatattcgccatccccgccgcctataaaatcgtccccgacttgattttctcttgaaatcgtcataaccactacgatacataaaacaaaaaagaagataaaaggagccgagaataccaaaggaagaactacctttttacttatcatcttgttctttcatcccttctcagtcgatcttctacttttgatgaagagcgtcttgcaatttcattcaaagacacttggtcaaatgaattaacgctttgttcagtccgtttaattgtttgtgatgaaggctgtttttctcttgatacagtcttattttcagcaggagcaacagcctgtttttcatcaacacgaataccatctgaatgactttttgcgggttcagatggtctgatttcacgttcgttattggcaataggctgattttctacttttgtagattgaggactttcaaaaccgaactgcggttcaggttgattcatcatgactttttgatctgaacgtttgatttctgctgttttctcttgtgctacaggctcactattggaaacagaatcatctttctggacttcaaaattttgttgctgatctgtttcaagattctgattttgttcgtcataaacatacgctttctgatcagtacgttctgtatctttttcattctcttgtaagacaggcgcacgattagaagtagattcttcttcatgttgtaatgatgcatcgtcagtttgttgctggatattggtctgtttatgaagctgttccaaatattctttttgatctgttcgtgctgattcatcttttttatcctgcaagataggtgctcgtttggataaatcctcatttccttcattcaaagcatctttcagcataggagagtttatcccgtcttttctcaatctgtctaaatgggattgctgtttattttcttttgcatttgcaaaggcttctttttgtttttgcttttcttgttctttcgatagagtttgaggatttcgttttaagcttcgactgttatgattagctattccgttagctgtttctttttgcggggttcttgaaatagcatgagtattatcatatcccatagcagccccactcggtgaattaccgccaccacttggagcaccagttacgtcatcagcattcgaaccgtcttttcttcccccaaaatgttttgtaaagtcagtaaatacaccgcctccgttaccccatactccacctattttcttcgcttgttcccaagcaggctgaacaatgttttgtctcatgttttccatcatattattatcaactgaaacaacttttccagcagtcacaaacttgataatggcatccctcttgtgaaaaccaatccacaagattgaagcaaggacagcaacatttaaaagatacattccaaaaccatttggcggtattaacttgtcaacgataaaacaagtcacgtacacaaacagaacgataatccctaacattgctttcagtaggtaaacactcccaagcgtccaagcgtaacaaatcccgaataagctaattgaggaacatacgctaggatgaaagcaaatggcacaaagaaaactatcactaaagcgacaacttgaagcaagaaattaaagaacgctaatgctaaaaatggtatcccaatgacaatagaagcgaccacagcgataaaagactctcccagctgattaaacacatttccagaagtcatagattcatttttataatcatcaatttcagtctcttttatataatcttttttatctttttctccatcctctgaaagcttataagaaagcagtttatctatacgattaagtccgcctttatctgtatctttctcattgattttcttttcgcttgtttcatcaaaattcacaattaaaaaaggcttcattaaagcaatgtcaaagtaaagattacgcataaccgcaaccgtgccttccatttcttttcctttttcaatcgctgaactgtctgcaaaattgccttcatcttgaacaatgccaaccaatccatttcccgcagttaaaagctttccttgcgcttctacagacaaggcattcaacgctttcatgtaataaccagcgttcgacatccaaagcccaccgatcaccataacacaaataaatagaatactccgccgcattgcttcttttacgctacctctcacacagaataggtagacaacataggcgcacgtgaaaataaataaagcttcaccgaaattctttttcagtgttttataaactgttttagagacgtttgtaatagaatttgcgaattcgtcaatcggttgcaagttatacaaaatatccatccccgcatcaaccacacggacaatgtttcccgcaaaagaaaaagtgacgtttgtcagcccaacaaacgcccccttgattaaatcgtcagatgcttcattattcgcttgatagcgtgagataggaaaccttttcaccttcaattccacaccgccagctttttcgacttttggctgcgtcgttgtatctccatcagccgaaaataccgttacagctgaagcaacagttaaaaacagcaacacgatagcagacacaatcagtatccttttctttttcattacagccacctcctaatctaatcgagttaataaataaaattggtaccttgctttctctaagtctctttgcgttaacagcacattttcgggatatcgttcatacagagagaaacagattgctttttgatatttcatatgtctgaaagtctttcggttttgttcaatcttgatacccaataatttttgcaggaactgcgctgttgatttatgcccgatgaagcttttgtatcgaccgtcataatgatttagccatcgttttacttcgtccagtgtaattttttcagctttataaaatcctggactcgtgaccacaagagagtttaagaaagctatttccatgtacaattcaaccccttttacaaatatttttcttccgcatatgcgacagcttttttctcaactgttttcagagcaccttgccattcttcgaataggcattcaattgaaattttggaggtacgaccatagtaatctttaaataagcattgaccttggaacatggattccatcatttttttgttttcttttgtgacctccatattcatccacttcaacacttcttcacgttcatttggttcgtcaaaggcgaaggcaacaccaaagtttccggaatcttcttctttcaaagcgtcttttgtggattgggaaatgaagtattccgcattgttgtatgaacgaccaatccggcgcatttgtctttctactttttttccttgttgtgacgtggtaaatatccacgcttcgtctataaattcaactgtctgttcgtctggattcatgccgaatagttcgcagaacttaccgagtgcaaacatgacagcactagactttaattgtgatatggtgtagttttcaagtcgctcagcatgatctggcaaatccatattttcaacttctaaaatggtgattcgtttttcaagtgacaatgcaggattggagccatcatgaatacaaagtttcaaaatggaatcttgcacaacctcatttaaatagtcaccagctttttgtacagcttcttccggatggccctgcatcttccgaataatatcaagcgaaccgacctgttcgcctttttgttttgcatcaattacttctgacgtagcacgaaggaaagctgtgtttatgtcgtccttccctttaaagtcatatacttgttcaaaaatgacttgaactagctcttttgctttcataggagggaggaaggagatagggtcaagtgctccccagttgtgcgtgttttcatgatctagcgtgatatagttgtatttctctaaatgtgcaatatataagggaaagttctctctaatgtactcatcattcaagactctttgaatccactttctcatttcctttttagggtctatatacaaagatttgatgtttaacatgctgatatagttaaagatcaattttgctagatatgacttgccgtttcctgtgtctcctgtgattaagcagtgaggagaacgtgtctttgaaccttttaactgctgattcgctaagaaagggtggaataagacaaaatcacggctggacataatggcactttctaagtcggtgtgctcttggaaacgatcaacccaaccgagaaagaacccgattttcgaaccaatatcagagttaacagcaaacagactttctgccacaccgtcttgcgttgttttttgaatccagttcttatcggttatgtctaacttttcaccaggaagcattttataaaaaaggttcagttgatcagccaccggaagccgacaagtaatgccagcgccttttaaatgccttttgacaatcgttgcttttcccacacattctttttttgtctttccatgaacgactatcactgacagccagttcatcacatgcacatcttctttctttatttcatcttgtaaatgccttatcattgtggcacttgtgacagtggaaacatcacttcgatcgcctgtgctttgttgttctttttgttcttctttcaattgttgtcttttgaggttgagggcaggcttggtaatggactttgattccgtttgaattttcatctgaacttcaacagggaagggaagagactgtgcttcataaaacaaatcactttccgacatattgtgaagaaattcgtcaatcacgacaaaagctgaatagccttcatcttgatcactatgcaaatgcaatactgatgggtcagtggggtctatgatcgtgtttgtaatagagcgaacatcctttatctcactttcttcattcgtttggtgctttaacccacgtacaaagtgataacggttaatgtatgtcatttctgtttctgaaagccgttctccgcgaacagaagccatgatattcgctagtgtttcttcgacttcctcatatttttcaaaaaaagaggtggaaacattttgttcccacccgagcattttcacgactgtatcagtcgctgtattgaaaaaagataatatattgtctttaagttcgacactaatatttacaagactgcttttcagttttacacctaaaatgaagtcatactttgtcagccttcctaatcgctgttctaacagccttaccgtttcttcattgtagtaacgtgtcacatctattgcatctgcggcaatatctgtttctaaatccttaaatcgtttttctaattcatactcacttggatacatcatcaagtgaaaatcctcataagatgtaatttcttcaaaaagatgctgccacttcttcttatacgattcaactttttctctattttgcataggaatcgaattgctttttattcggtagtacgcccacacgtcgcccgttcttgttaacagtaaatttttgtgtattgccttcataggcgtttttagtctcatttgaataatccaccaccttcacaagtttttgaaactcaatttgtttttcgttacttaaatcaacctttcggtcattgcaatacttcttttgtggaagcttgatgaagaagtaatattttgcgaaatcaaagaaatataaatagatgtttttgccttccggctttattttcgtcacaagcatcgttaaaaaaaatggtattccaaaaatcacgatgacgtaactattatcaaaagcgtgaggaaaaatcatcctcacgccgtaccagaacccaaagcataggccaacaaaaatgaaatagttaatagccggtattaactcaactgcaaagggtaacgaataattttcggttaattgctgaatttttttcggctctctcattgctttccggtagttgaacaccagacgccccattcagatgcccccttacaatttttccattagcgcattgatccagccggagaattctgaccagtgtttaataacccacgtcaccgcactgccaatacagcaaacaaagataatgccgcccatttttaatttcatcagattctttgcggctatgaacatgaccacaatcgtaatgaattggataacaacatctgaagcccatccttttacccctccaagtgttggaaggtctgcgccaagaataaagaaattcatgaaatccatatttaaacctcctattgatgtttgagtttatttacataaaactgaccgctgttttccgtaatctctaaactaaatttttcatttacgggaatatcattttctttttccttaaatcgaacagcacaaaaaacctcgaaaccttttttcgtctcgaagattttcattgactgcacttccccaaataacaagtttccttccaacgcttccggctttttcatcatataaaccatttcttctttcttttcagaagcgtatttctcgaagaaagtatgaagaaatgattcgatagattcttttttctcgcctgcatattcgtctctagtgtcttctttgccctcagaagtaatattgcctttcagatcataaatctgtgtaaagtaaggaacagcagacaccgcaaaggaatcacctttatttgtgactggaatattcagcaacatttgtttttcagatttctcgtttgttttaaccttttctttcaccttcttttttttctttccgtctttaacttctttttcaacttccttctctacagggtagagattttcatatgtgaccttatattgaaaaaggctgtttttatcaccttctttcacgttatataagctgtaaccctttaactctcgatcaccttttaagccatccacattaaaacgatcttcatcctcaaaatggttatcttcctgtttcaccatgtagctttcaaggctctgcatgcgtttttcaatagattcttgatcgttcttcacattcacatattcattgatgaaccctgatagaaagttttcagcagcagtcaccgaaattttttgtttatcttcatttgttggcttattcgcttcgtctttcatgtcattaagttgggatcgagtattaattgacagaagcacagcaagcagacatataaacagcaagccccctacacaagaccataatgtaactgctatcagctttgacctgtcacgaggaactttctgtttatctttttccggtctttcaattcgtttcagtttttgaaaggcagaccgaaaaaaggactcttcttttttatccaagccaatttctttatggagcaattcgattcactctcctttcatatatttctaagcactttcctcctggttaactttcatgtttcttgtcattttcaaaatggctctagccattttttcatagttcggttcgtttaactccgtcacaatcacttccactggcttacctttaatttcaacgacctcaacactctgtttcatgaaagacctcgctttcttcaaacctgttttgttttttcaaggaataataaaaaggatgctacacggtgtaacaccctttttatgctttgattctccacataaacttttaagctggtcattcgaccgtccggcaaatatcttgtcttgtaaaatgtgtaacgatattcagcaaatccttttactctttctccttctacaactaacatacaatctctgcttaaacttcttacaaaaactaaagagggaataccaacattaaagcccagtcttttgaagtgattatcaaccgcagacacttgatcacctcgttatattcgtcctccgtttttaagatgattttcttcgtaatcttttcttataacatgaggatcatacattacaaattcgacaagaactactccgtcatctgattccgtttcattttcttcaaggactctaaagtgaaaatacaagttcgcaaccatgtccccgccgttatcctttctaacatgaataatgatcatttgatcatatcccgatgaaatttcatcccttaatctttcgagtacgtcatccaacaagtgtatattaagatgcctttctaatgtgtttataagggaggactcatttataatcctgtaatccatgttttcacccctcagtgatagtaggttattccttcaaattcgacgctccgttcatctgtctcaaaatcttcatcctccagtatgttgaatgtggcttgaagtttagcattcacattatctataaccgcaagagtttggactatgactctttgagcaacatcactgtaaaagacatcttccatcattttttcaattaattcctcagcaatatccaaacagccaagagactccaaatcactctctagtcgggcctgattcaacagattaatgttaaacatcttatccctccgatttaagttcttgggtttcacccaaacccaccaacggtagcccgttggattcctgttaatctatccccctattccccgaatcatcgggggactccctcgccggtaggcaggaacaaacggttgtttgttcaatgccaagagggttttggtggcgctgaatatgtcaactccttatcctcacttcgttccggtaccgttgacacatacgtttaatcgcatcacttatgttcataaagatttagtagcttgttttcaaacgaccatatcagcaacatcagctataaacacattcaacattttttcatgtttttccgccagttcagcttctgcgatcatatctgacagatcagttttccctaaatgctgatcagcttccagcaccattttcatagtgggagcgcaagagttacgaagccagtttcttgatttttgatagaagtctttttgtggtttgacgtacaaaggaagttttccaacatcacctataaattcagaccaaaaaaggctcgttttccaatgctctctagtgatgttttcatcagcatcaacgaaccttacatagttattaatgatctgcatagcgattaaggttaaatcctttgttttcaataaagcatctatagccacttgtgcacgttcatttttaagccgcaattcataacgattccaatcgcctagttcttctaacggaatgttatacttttctgcttgttcatagtttttctcataaaagcaaaggtacgcttctgactttttagagccaaaatatattgtcgttccgcctgtaatgccatcagatagatcaaaggagccattgaaatcggattttctaaaacgtgaaatacattcgcccttttgggctttctttaacaattccggtatagaaaagtacgtctttttatcatcagtagccaaatcaaagcgagtaaatgaaccgccttgtgccatgcaatcttgaaagaagtcgtaccatgttttcttccggcattccaagaaggattcaaattgacggcaaccttgaccggacatttctatcaaaacacctctgttatcatccggcgcagaataaaagactttgatatagtccagttcgtaagtgccaacgtagccatagaaaccagattgtttctcagtcataaagtctttgctaaggtgaagaacctcttcaataattcggtcaacatcatgagttttaaaagagactcgaatatagtcaaccattgataccaaaggactttcaacggtttcattttcttcttttacgattactaccccctgttagcgtggggggttgttttagctcatccattcgcttcgctcactccttcgccgctggccgtctggtcgcttacgctgccgctggcgactgccgtcgcctgcgctccctcgactccaaccagcgcatttttaatagatgacataaaatcatatcctttcggcacgatagggctgtaaaactccaacactgaacctgtgcccacattggcatatcctcgccctgtctcctttttattcacatatgctttttcaacatcgccaaacatcattccgtaacccgtatcggacattaaacccaatgaaacacgaaagctaaactgatcacgaataccgtcagctaaatattttgcatctggacgttgtgcgcctaaaacgagaaaataccccgcctgtctccccaacatgaccaactgtttcatgtaagaaagggcttcgtttctttctttcatatctaacaaatccataaacgccacatattcatcaaagaagataaaaacaggttttaagcctaaataagcatagttttcacctgtcttatagttagacatttgcttcatttcatccattcgttccatcatgccatctacagactttctcaggcacataagaataccgttcttttgggaatagacctttttcggaagtacttcttccaagtctgctaaatctgcatttttagggtctagtattcttacatctgcccccagtccaacacatgccttaatgatcgttagcatgaagtatgttttccctccacctgtaccaccagcaataagcatgtgcggcaacttatcaaattgccatgagatatgcttcattaacggaaggactccattctcagctactgcatcatcaatggaaatacgattctttttgacatcgtaaagaagcttaaagcatacaaaaccttcttccatttgtttatcaaccaagtcacaaaataagccgttttccaaatcctttcctaagtctaggaagcgattctgaaaacggctcatgtccatagcaatacgaatatagatgtggttgtttttgacctggtaatacattctaggaaagtatgtgatcttttcctttgagtcagtttcatttgaaaagatttttcttactttcacgttttctttttcgtaaaacttgttagagaaaatcattttagcaatcttttgcctgtgaaggattttcttatagctgtcaaacaaaagaaagtaagatgcaactatgcttccaacagcaattagcacagagcataaaacgcttttaatgattaaaggcacattccattcaaaattttttatcacttgagatagatcaaaatgaatgagttgttctctccaaaaaaggaacatagacaataaaaaacaggcacaaagatgattgcgcctgctaactttacgttgtttctcatgtacgggcggattcgtttgcccctgtatttccaaaatcttttgtttaagaaatcactcatatacatcacccgcctgccgatatgagagcatcatgttatttcttttcattcccgccagttgccgcggcaggtttcacagaagagccacctttaacaacaatatcatcagcttcaagtttccacatcacattggcatacgtcgaatccctttgactagtcgccatagcgctaatttttgggtttttcaactcaatatctgcaaaaggaggaatttcttttgccccagcatactcaggaatagttacttcaatttgaccaccttggacagcactagcaatgttataaatcctagattccagtacgtcagtacgcttattattttcacgatcataaacatacctttctctgttaagtcccatgaatttcatgtctccaaaagtcatattgatatccggtacaataaagtttaagttcatttttcatatccccatttcatttttttataatttatttacaaaagaacattaatttcgattttatgtttttgattcgctccggttctgtatccatcttggcgcttatcagttgctaacggctttacgccctcatggcaacctagtaggctaattatagccatcaagctgactacagctattccgcacgcttattctagcctgctacagcatttaaagtgattgctgttcatcactcaaatactcacgcatgacatttcaacaagaataccgtataataaaagtgtctagtttttattgtcggcgttcttgatgattattcatcaaggcgctttttttgtctgtatgtagttttcaaagaacaaacactcctagcgacataagttatacagatcatcgttatataaagtaaacacctggttttccttcttactcattggtcgagtagaccagatacaccaccaatcccatccttttaacagctcagatatttctttattagctttcaaataattatcagcttcaacaacgaatgtttcacaagtggcatagtctttaaaatgattcaaatccttatcagcctttaaagcttcaacatcagtaatgattgttgcattcacccttattttcatcgcatccccctttcaaagtatttttaacggctccctatagtggtatataacgtcacactatggatgattgccgcagcttttcaatgtcttttctcccaatgccgtaatgtttacatattcttcgatatgaaacacctttccgcagtaattcattaacatttgcgtttgttaaaggaaggtttaaataatgctttataatgactgaatttagagcaattttcattcttactgtccaatcaccttccatttttccagccaacgaaactgcctctttcattaataaatgagtatcaatccttcttattcagaccacctcatttctttcacctttataaatatatctagaatcgaacttgattttattaacccgaccttttaaagtcttataaccttcctcgttcaactctttgttcagactacggatgattttataagcttttgctctgcttacatctaaaattttttcgatatcttctactgtataaaattctttcactaaatccccccttacaaaaattgtttaactccttattggttaactttattataactctccgtttcggagatgtaaagaaaaaaatgaacaatttggagatttttttagaaaatatggaaaagttgttctgtttttcaaaaatggagaatgtaataatcagcacaaaacggagagttttcataataagtacactttttgttcattgttaattaaaacccagcaattgctgataatatattagtaactcaactctttgtggaatggatgatcttaaatgacattaggcgaaagattaaaacaagcccgtaagaaggccggactctcccaaaaagaagttgctcaagcagttaattcaactgagaaaacaatttctaattacgagagagattacagagaccctgatacagtaaccctttcaaagctaagtgatttatacgatgtatcaacggattatctattaggacgtaaaccaaagaatatgtctaagctggatgaaacattaaatgaagctattgaagaattaaaaaatgaagaaactctcctttttatgaaggacgaggaaattgatgaggaaactgctcgcttaatcaaacaagcattaatcaatggaatgaaatacgttgacgcaatgaaaaagaaagagtgattcttatctatacttcaaaaaatatcaaacataaagcagaaagagttattcaggaacacggaacaaacgatgtctacgaaatatgcgacaacctcaacatttcaatcttaaaaagtaatttaggtcgcatcaaaggctttcttcaatattacaaaaaacatcatcattatttaatacaggtaaatcaaaaataccaaaacgcaaaaatcataattgctcatgaactagggcactactttctccataagaacttaaacacattcaaaatggaaaactgctctctagttctaggcgaaaaattagaacatcaagcgaacatctttgcgacagaattacttttaccggactatgttctagcaaatgagacaacacagttgcaaaactggtctcttgatcaaatagcttcttttttccaaatccccttatttattgtggaacataaaatcaaacatatgaatctactaactcccgaaaaaacagtaaaccaaaacatattaacagctctaaactaataaaaagaaacgggtgtaccattgcatatgaattggcatatcgactggggaacagtcacgtcggttgttgttgctttaggagccgctgctacggggcaaataattgcacatcatttttcccaaagtagagaagatataaaatttaaaaaagaatgttttcaaaacttgtattctcctataattgttaaaatagataattatctttttgcagagaaccaaaaaagtatagccttgggaacaaagagcgaggaagaatataaccaagaatacaaagatgattattttaatcctaatagattattcactgaaattgttaatacagttggttcaaacttaaaatacgcaaatcaagaattaattatgcaatatcaagatactatagcattacctcatatagatgactcattggccgattgggtagaacccaaattgaattttgcgacaaattcctaacagagtatgttcaactaagtaaagacttaggagtgtattcaccaaaaatcaaagaaacagttgagggatgtttagctttcactcagttatttaaactattcttgattgttggatatgattcaaatgaacttattcgccaccaattaattattgggaatttatcaaagtatttaaataaaattgtgaaacttaacaaaaagtttaaaaaaaaggaattaaccagggaagctacagttaagcttcgaatagaagtagatacgttattgcaacaaatacaagatagcttaccagaacatgtatcaccacaaatattttctaatctaaaaagtccgaccgacaatcaatggcaatccctttaatcataaaaatgaaaagggtattttatttccaaactgtgatatgttaaaacatgatcattatttaaaaccattaaagagagaaggtgatcccatgcccactaacaataaacccaatagattaatcgctgagaagtctccatatttacttcaacatgctcataaccctgtgaattggttcccttggggagaagaagcatttgataaagcgaaacgcgaaaacaagcctgttctcgtatctattgggtatagctagctcgggtagctacacgcacatgtcattggtgtcatgtctcttaaaataaccacaaaaggcaaccagtttcggctgccttttaataattttattgcaaatttttagaaacctagattcaaaaactttttctcttctaatttaaatactgttgttttttcttttgattcattgcattttatcttgacctctaatttgtgtcccttaatatcttcctaaattctaatcaattcaaactcattaaggagatactttatcaccaactttaaataataatggaataagtgctaataaaataattcctacaaccaacgtagatattattaactccttccatacaatcaaattctttacaaacatttgataaataactaatgagtttactggaatgttaagcaataagcccgtaagaagtccaggtgcgtactttttcattaaaacagttgcgataagatgtggaaaaatagcgttgataaccatagaacctagaaagccaatgaaaatccattttgcaatatctgattctggcatatataaaaaaccaaatgcagataaataagccaacatagttataacaatgacagcaaaatgaaattcatttgaggttactggcttttgaaactttgaaggttgttgtgaccacttaggtaaccaaatagcctcctcaatattatgcagtgtaatagcaaaacaaaaaaatactacgaaataaaccatctttcatttcctcctcggtgccacgtctcttaaaggaatcaaccaatatggtttagcaacattatattacatatgagggtgaactgatatggtgttaaaagacagaagaagctgcctaagtattttcttctcttttttatatgtgcaataacgtgttgttggtgcctcgtctgaaaattatagatgcgatatactatgtaaaatagtataaaagtatagaggtgtaaaaatgagagttgcttatttaggcctaatcggagtttttcagaagaagcctcatttcaatactttccaaagggtactgaatggaaaatgtgcgacaccataataaacgttcttgaaattgtgggtgaaaatcgggctgataaggggatcgtaccgattgaaaattctattgaaggtacaattaatattacggcggatggcctactccgaaatcaattatttattgaagcaaaggaatcaaaataagaacttgtaagcttctgaagaagtggacaaaagaagggttttaaatacaaagtagaatatgttatacagatatagagagataatataattcatttgtggcaaattaggaatagtttgatttgtttgagactacgtagaagaatataaaatgtatgtgattttttacccaatcctatatgtcttattctatggaggaaatatgcttaaagataactttaaaattaggaatatccccgcggttttatggggagaaaagagtgaaaaaatttttattgcagtacatggaaatatgtcaaataaggaagatgcagtgattcaattattagctgaagaagccaatcaaaaaggttatcaagtattaagctttgatttacctgagcatggagaaagaaaaaatgataatactccttgcaaggtacagctttgtgttagtgaattatctataattatgaattacgcaaaagaacactggaaagaagtaagtgtgtttgcatgtagtatgggagcttattttagccttttggcgtatcaaaatgatgtgttaaaaaaggcattatttttatcacccgtagttaatatggaacgaattatcgaaaatatgatgaaatggtttaatgtaacaccagagcttttgcaaaaagaaatgactatagaaacacctattggtcaaaagttatattgggattatttatgctatgtaaaagaacatcctattaatacatggaatacagatacatatattatgtatggagccaaggatgaactgtgcgaatttgaaactattaactattttacaaaaaaacaccgttgtgaattagaagtcctggatgcaggtgaacattactttcatactgaagaacagttgaaggtatttgaacagtggttacacaagcatatagattaacaaattacaatttatctagatttatcagaatggtggaccaaccacatcgatgactaactttttttatgattatcttattaaacgaatgtaatgtcacattactaatgaaagtatataattcaataattgtggtacgttaaaaaaagaaaattattagatgaaagaaggtgatcccatgcccactaacaataagcccaatagattaatcgctgagaagtcgccatatttacttcaacatgctcacaaccccgttaattggttcccttggggagaagaagcatttgaaaaagcgaaacgcgaaaacaaacctgttctcgtatctattgggtatagctagctcgggtagctacacgcacatgtcattggtgccacgtgatggctcacgaaagctttgaagacgaagaaatcgcgcgtcttctcaatgaacggtttgtggcgattaaagtcgaccgggaagagcggcctgatgtggattctgtttatatgagaatctgccagctgatgaccgggcagggcggctggccgctgaatgtatttattacgcctgatcaaaagccgttttacgcgggtacatattttccaaagacgagcaaattcaatcgtcccggttttgttgatgtgcttgagcatctgtctgagacgtttgcgaacgaccgcgagcatgtcgaggatattgcggagaacgccgctaaacatttgcagaccaaagcagccgccaaatcaggcgaaggccttagcgagtcagcgattcaccggacattccagcagcttgccagcgggtttgatacgatctatggcggtttcgggcaggcaccgaaatttccgatgccccatatgctgatgtatttgcttcgttatcatcacaatacggggcaggataacgctttatacaacgtgacgaaaacgctggacagcatggcgaatggcggcatttacgatcatatcggctatgggttcgcccgctattcgaccgatgacgagtggctcgttccccactttgaaaaaatgctgtacgacaatgcgctgctgctgaccgcttatacagaagcctatcaggtcacgcaaaacagccgctataaagagatttgtgagcagatcattacgttcattcagagggaaatgactcatgaagacggaagctttttctctgctttagacgcggatacagaaggagaagaaggaaagtactacgtgtggtcaaaggaagagattctaaaaacgctcggagacgatctcggaacgctgtattgccaagtgtatgacatcactgaagaaggaaactttgaaggcaaaaatattcctaacctcattcacacaaagcgagaacaaatcaaagaggatgccgggttaaccgaaaaagagctcagcctcaaactcgaagacgcaagacagcagctcttgaagacacgcgaggaaagaacctatccgcatgtcgatgataaagtgctgacctcatggaacgcgctgatgatcgcgggtcttgcgaaagcggcaaaggtataccaggagccgaaatatctcagcctagcgaaagacgccatcacatttattgaaaacaaattaatcatcgacggccgtgtgatggtccgatatcgtgatggcgaagtgaaaaacaaaggctttatcgacgattacgcttttctcctatgggcttatctggatctctatgaagcttcgtttgatctttcttatttacaaaaagcgaagaaactgacagacgatatgatcagcttattttgggatgaggagcatggcggattctacttcaccggacacgatgcagaagccttaatcgtacgggaaaagaagtgtacgacggcgccgtgccttccggaaacagtgtggcagcagttcagctgctgcgtcttggacaagtcacaggcgacttatcactgatcgaaaaagcggaaacgatgttttccgtgttcaagccagacatcgacgcgtatccgagcggccatgctttctttatgcaaagtgtgttaaggcatctaatgcctaaaaaagaaatcgtgatttttggaagtgcagacgatccagccagaaaacaaatcataacagagctccaaaaagcctttaagcccaacgactccattctggtggcagagcagcccgagcaatgcaaagacattgcgccatttgcagcagactaccgcatcatagacggcaaaacaaccgtgtatatttgtgaaaacttcgcctgccagcagccgacaacaaatattgaagaagcgatccacacattaataagcagcagggattaagacccttgctgcttactttttgatttcttatggtaccataaagcgatccccgcaaacacaaggttgaccgctatcgtaaagaaagcctcccacatcgggttcccccgcgtaaccgtaaacagagaaggaattcctccatacacactgtttttttctgtaataaacatacacaaaaacatattattcgcggcatgggcgccaagtgatatttcgatgcttccagttttaatcgtgtaataggtccacacaaaaccaaatgttaaatactcaattcctgcccagacagcgccattgttcatttctggattcgcaaaatgcaatacgccaaacaatcctccgacaatcagtgtcaaaaatagaggatttttcgtcaatctcccgaaagcttgaagcaaaaatcccctgaaaaacagttcctcagctgatgtctgaatcggaaccaaaatgagggcagccgctagcagccagataaatcgtgatgcattaaactcttgcattgaatagctatcaggatgaatcacaaaatcaatcaattgtacggcgatcattagcaagaaataagcaataaaaccaaaggaaattctccgccaattcatctttgaatttggtgttatcaccgttcggaaaggccgcttcaaaataaagcgcacagccagccaaactcccggaatggcgaataaataaatcacatgggacaaataaagatctacgagaggatcactcaacacagcttcatccaaatcaaacgtgatattgggattcacaataaccgtgaacagtatagcgaaaaggtaagctatattcccgaatacatataaccctaccatcaccaaaaaagcgaaaaaatatctccacaatgtattgtttccttctataggacggataaatgaattcattccttctatgtctcttcctttcaatgagaatattactatatatttgcataaattggtctatgaatctactgttttggaaatcttttaagcaaaattaaaatataaagtgtgaatttagttcttccatctagtgatttgaactctgttgccaatgaaccaagatacttataatagtcccaagaggggaattttcagtcttttcttactacttaaaagggggttttttatgaatacgatcttcaaacaaaagaatacacatcctttctcaaacgcagcgaatcgtttagaccgccttccgatttcacgcgttcatttccaagtgttaaccgctctcggcattgtttatttctttgatctcgcagatttatttaccctcagcaatgtagcgccggcactgattgaacattggggcatcccgctttcaactattgctaacgtaacggctgcttcgtttttaggcatgtttttaggcgcttcactgggcggacggctgtccgatcgaatcggccgcaaaaaagccttaaatctatttgtctttgttttctcaatcgcatcgctatgcaatgctgcggcatgggacattccatctttaatgacattccgtttcctcaccggatttggcgttgcagccgccatggtcattacgaatagctatttggcggaatttttcccttcaagtgtacgtggaaaatatatttctttttgtgccatgattggattgattggggttccgatcaccaacattgtgtctgcctttgtcattcctcttggttcatggggatggaggctagtatttgtatggggtgccgtcggccttatttattttttcttcatccgccgtctggaagagtcacctcgctggcacgaaaatcgcggggaatatgcgaaagccgatgcgatcctcaaccgaattgaggaacaggttgaaaaggagaaaggcccgcttccggcagcatcccagcctaaagtaagcgaaactgttaagcagaatgcaggttacgccggcttattgaaaggcagaaacctcaaaatcaccatcgtattatctgctgtatggatttttgaaacgtttgggttttacggatttgcttcatgggttccaagcctgctaaaaagcaatggcgtaaccatggaaaatacattatggtataacgtattgcattccgtcggcgctccacttggcgcactgctcggctccatgatttccgaaagatttcaaagaaaatggattttagctgcgagtgcgtttctgacggccatcgccgggctcttatatggtatgacttttattcccatcatgatcattgtatttggttttatcgtgaatatcacagaacgggtctttacctcgaacttatacgcctatacatctgaaccttatccgactgaataccgctcgtctggcagcggtttagcctatggtcttggccgtttttcaaacatttttggctcattgcttgtcggatttattgccgttcagctcggctatatcagcgtcttcttatttattgggggctgctggctcgcatgctccttgctgttaatcttcttcggccctaatacgaatgcaaaacagatttaaaaaagtcagtgcggatctgccgcactgatctcattacaattgcttcaaaatccttgcggggtttccgcctacaacagtattagcgggtacatccttagtgacaacagatccagaagcaatcactgcgttatcaccgattgtcactcccgggttaatcaccgcccggcctccaatccaaacttgatctccaattgtcacaggcttaccgaactccttcccggatttcctttcgattggatcaagaggatgaccggccgtgtagatatgtacacctggcgcaatcaaacaatgacggccgatacgcacctcacacacatctaaaatgacacagtcaaaattaacaaatgtatgatctccgatatgaatgtgatagccataatcacagcggaatgtcggcaaaatcgtgacttgatccccaaccgaaccgagcagctccttcaaaagctccgtccgcactgcatcatcttccggtgtttcgttatattgtctaatcagctgtctcgcatgcttgcgttctagtaatagttgttgatcttccgaattgtataattctccggctgccattttttctttttctgtcctcagcatgtaagtcactccagatgtcagattgtaatctcgatcaaatttccttcatcatcctcaatcacactttcatagtagccgtctcctgttgtcctcgggccgtttactactgcgaaaccatccgccttcaatcgatcagtcagttcgtcaactttctcccggctcccaacggaaaaggcaatatgtgcccagcctgtcattgtttgtgagggcggatcgatcacattcccttttttcataatctccagccttgctccggaatcaaacgtaataaaataagacttaaaatcttttttctcattatgatacaaatcattcgcttcgccattaaaatacgattcataaaaagacttcattcgctctaaatcattgacccagaccgctgtatgttcaatctgcatttcttcctcctccttcgccttcaatgaagttataaggtatgaaatgcatttcagttcaagcttttttcttaaatttatgctgaattttgatatcagcgggttcatcctgcaaaaatagagaaaatgctgcgatgccgagctgctcaagattcaaatcaagcgacggaaaaccaagaacacggctgatagaagtatttccctcgcctatgatttcaacatcccaattattctttttggcaaatagatgaattccagctgccacttcatcactatttgcataaatagcagtcggaactcgcccgctcatataaaaatgttcagctgccagctcaccatcattcatatcgttgcatccggacagcatatggtggtcttccaaccttccgcagacagctttataggccgcagctttatcagccgtgctcgggctcctatcagcttctctgacacacgtaaaagcaatattctcatgcccgcggctctttaaatagcgaaagctctctgcataagcagcttttctgtcattagaagcacaagggacatcaatgtctccggtatcctcacaagcgatgactggcccatattcctgataagctaaaatgctgtcccaatgattggcgcgggaagtaatgatgagaccgtctattttcttcgttcttaacagctctaaatatttgatttcaatatcggggttataattggtggggagaagggtcgttgcatactcatgctgaaaagccgccttggtgattccgttaacgattttatcaaagcagggatgatcgctataaggcagaatcacaccgaccgtatgggttttcccgcgaatgagatcgattgcggttcgatttggtgtataatccaattccttcatgacttgatgaacaagctttctcttttcttcagatacatacggatgatgattcaatacacgcgagacagtcgaaacagatacatttgccagtcttgcgatctcttttatatttgccatctctttctccttttcatataaaaaaagcagtaagtgtaaaatccttactgctatctcatcatatattgatgataagttcaacaggacaatggtcggaacccatgacgtccgctgatatgctggcatcttcaatctgttccttaaggctttcagaaacaacaaaataatcaatccgccatccaatatttctgtcccgggcgccggcacgatacgaccaccaggaataagcgccttcaagatcaggataaacatgacgaaaagaatcaacaaagccagcttctaagaaacgagtgaatgcccctctttcttgatctgaaaatccagcgttattccggttcgcctttggatttttcaaatcaatctcctgatgggctacattcaaatcaccgcataaaatcactggttttttctgatccaattcaagaatataagacaataaagcctcttcccattgcatgcggtaatcaatccgctctaatccccttctggaattgggcgtgtaaacagtcatcacaaacacgttttcaaattccagcgtaatcactctgccttcttggtcatgctcttctactccgataccgtagatgacctgcagcggttcttgcttagaaaaaacagctgtgccggaatatccttttttcactgcataattccagtacacatgatagccttcaggctggagatcaacctggccgtcctgtatcttcgtttcctgaagacatataatatctgcatcctcttctttcaaataagagaggaaatccatttttctcatcacagcccgcaggccgtttacattccatgaaatcaacttcatgtttcatcctccccctataaaaagagcaagaacccgaaggtccttgctctttacatatcagcttactcaccgcttacgtatggaagtaaagccatttgacgtgcgcgtttgatcgctgcagtcaatttacgttggtatttagcgtttgttccagttacacgacgtggtaaaattttaccgcgctcagaaacaaactttttaagaagatctacatctttgtagtcgatgtgcgtgataccgttagaagtgaaataacacactttacggcgtttcgcacgaccgcctctgcgtcctcctgccattgtcatttccctcctttctttttcattttaggcgataatcacattagaatggaagatcatcatccgagatgtcaatcggtttgccgtcgttggcaaatgggtcatcattaaagctgttcccctgattgcgtctctggttgttttgatttcccccaaatggattatcattttggcctccgccaaagtactggcctccgccgctgtttccttcgttgtatccacctgaaccagaaccgccgccgtttttcggctcaagaaattgaacactttcagcttggacctctgtcacgaagacacgctgtccttgctggttttcatagtttcttgtttgtaaacggccatctacgcctgcaaggcttccttttttcaagaagtttgcaacgttttcggcttgtcttctccaagtgacacaattaatgaaatcggcctcacgttctccggactggttcgtaaatgtacgattcacagcaagagtaaacgtagcaacagccgcaccgtttggcgtataacgaagctctgggtcttttgtcagtcttccgactaatacaactcggttaagcataagaaagaccaccttttaccattatatatttcaaaattgcttattcttcttctttaacaacaatgtggcgaatgatatcgtcactgatcttagctagacggtcaaattcttgaactgccgcagcgtcagattgaacgtttacgatttggtagaaaccgtcgcggaaatcgttgatttcgtaagcaagacgacgtttaccccaatcctttgttccagtgatctccgcaccgttagaagtcagaacgttgttgaaacgctcgataactgcttttttagactcttcgtcaatgtttgggcggataatgtacataacttcgtactttctcatctgtttgcacctccttttggactaagcggcccataatgggcaaggagcaataattctattactcacaattttatattataccaaagctcttgtccctttacaactgcatcctatacattaaatcggaaatgaataacatctccgtcttggaccacatattctttcccttcaaggcggacttttcctgcctctttagctcctgccataccgccgcccgcaagaagatcctcataagcaactgtctcagcacgaatgaagccccgctcaaagtcactatgaataattcctgcacactcaggggctttcatgccttttttgaatgtccaagctctgacttcctgttctccggctgtgaaatatgttgcgaggccgagaagagagtaagacgctttgatcagctgatcaagacctgattcttgaatgcccagctcttccaagaacatttgcttttcttcgccttcaagctcagcgatttcagattcgatttttgcacatacaacgataacttctgcattttcgccggcagcgtactcgcgaatcttcgctacattttcattgccagatggatcagcaacttcatcttcacttacgttggccacgtacaaaataggcttcgaagtcagtaaatggagctgcttcacaagcttttgctgctcttcagtgaattctacagatcgagcaggcttttcactctcaaacgcttctttcagtttagataaaatctcaaactcaaatacagcgtctttatctttttgcttcgcaagcttgctgacgcgtgtaatccgcttatcaaccgtttccatatcagcgaggatcagctcaaggttgatcgtttcaatgtcatcaatcggatcaacctttccggaaacgtgtgtaatgttgtcatcggaaaaagcacggacaacgtggcaaatcgcgtcaacttggcgaatatgagataggaacttgttgccgagtccttctcctttagatgcgccctttacaatccctgcaatatcagtgaattcaaaagcagtcggcacagtcttcttcgggttgaccagctcagtcagcttttgcagacgatcatccggtacctctacaattcccacgttcggatcaattgtacagaacgggtagttggctgattcggcaccggcctgtgtaattgcgttaaatagtgttgattttccgacgttcggcaaaccaacaattccagctgttaaagccattctttcatctcctctatataaaaccgtcattgtatgaacgtattttgaacctagagcaattataaggaggttcactggaaaagacaagctgacaaaaaagcattttcagcctgccaatccctttgattatgcttttttcaagcctactaaacagtcaaaaagcgtacttcccattccattatcagaatttgtatcatttgtcagtgcattgactgaccctccaaaagccgcccacatgccttcatctatattaatcgtcttcgcatgagcctgcttcatcactttcaccttgcccttcaagcttccgcggtcattaaagatgacaacttcgtctccatcctgaagatcctgcccagccgctatatctggagaaatatcgacctgaacgtgctgaagcttttcaataaacggcacatgctgtgaatgattggaacgctgcggatgaatggataagagcgtataagggtactttccagctaactcctcattatggaaaacagattcttcgggcacatttaattgaagcgagccgctaaatcctttttgctcagctagcgacgaagtaaattcaaattttccactcggcgtcaaaaactgataatcatcccacggcacctgttttactggaagagggaggtggcctttttcttttaaacgctcaagtgtcacatcctctgcttccaatgaagaaagccccatctctaaaaattcttgagtgctgtattcaaacagctcgccaaacccaagacgttttgcaagctctgaccagatccacctgtccgacttcgcttcaccctgcggctccacaagcttcttcccgtactgaacataatgatgatacatactggaatagtagatatcttcttcttcaaaaacagtggcagtcggcaaaacataatcacacagctttgcggtatccgtcataatagaatcaatcgcgaccgtcattggaaccttttcaaaagcttgtctcaccttatttgtattcggcacctgagtcagcggatttccgcacgtcacaataatcatctcaatcgcaggatcagcagcggtcaacacttcttcagcctgtgtcatcattgaaaaagaacgggatgttgtttttaattccggcagcgtcagctttgtttttgcaaagctctcaccaacctggacatttccgaaattcgcgccgccgcccttaattccgacatttccgcttgccgcaacaagtgcatcaatccaacgaatcgttcccccgccgtttttatatcgctgcatgccaagccccataaaagtagacaccggaccatcagcatacaaacctgccaaatactccagctcctccatagaagtttctgttttcacaataaactcttccagagaaacggtcttcaaaagctctttcacatcatcaaaaccgacagaatgctcagaaataaacgtttcatccgttcttcccatctcaatcagaaccttcaaaacggctgccgcaagccagccgtccattccaggctttacagagatatagcggtcggcaagcttagcagtcgggttgaagatcggatcaatcaccgtaatcgtggcgcccttctttttcacctgctgcaagtgatggtataagtgcatatttgttcttgatacatttcttcccacacaacaacatgcttgctgttgtaaatatcaagcggtccgtgaccgtacgaacggccaaaatcccagctttgcgcctcgatgccggagccccagcatatgcttccgacgatttcggtcacgccgccatatccattaaaaaaacgctgatcaagcgcttttaacagaccgttattcgcataatcatggctgtgcaaaacagcagtcgtctccgacgtttccttgatttcccgaagtttatcggcaatttcatcaagtgcctgctcccaagaaatccgcacaaactcgccattttgttttttcattggatagcgaagccgatcaggcgaatttgtttttgtctcaagcattctgccgcggccgcagattttaccttccgtaatcggatggtttggatctccgtccacttttgttacctttccatcatcaacagtcaccaaaaagccgcagctgtcccaacaattcagcggacatgccgactgatgcactttgctcatcgccgtcttctccttaccttctatatgaaaaagcatgagtgtcggcctatttatgaagtaggctcctcatgcttgactagtactttttttagttttctttcaaattctcttctcggaatcataacactgtgagagcacccctcacacttaattcgaatatccattcccatgcgtataattttccagctgttcgctccgcatggatgcggttttttcatttctacgatatcattcaggccaaagtctttatccgccaagacccttcacctcttttcctaaactgctgtatctattgtacaaaaaaactgatcataagagcaatcaagatacccgaaaagaaatacatcctcttatttccatttactcaaaataggatataagagcagacaaactaacaaatacaaattgagcatcccatatatcggatacaagaacgcgatcaaatcagaaaatccgaaagaagtaaaaggtaccattaacactaacaaaatcaacacaatcatccatctaggcatatgaataaacgccatcagccggctggacagccccagcaaacctgctaccgtcgtcgtgtaaatcgccaggcacagcaccgccgtcatacataaaaaaaggaaataaggcgcaccctccagaacggcaaacagcggtatttcaaactgagaaagggagcccgccagctccaccaacgtttcattataaacaaatgagatcacgccaaaaataagaccgcttgccacacttgcgatttttgcttctccgagccctttcatctctttcccaacagaggataaaatcgcaacaactgaaaggatgtttaaagaggtaaacgtaatgctcgcaggccagttatactgctgggacaaatcaatcgtccacgtatggtgatgtgtgctctgaaaggagatcagcgcatataaaagccccgctactaacacaggaatcaaaatactatttatagataatattcctttcacatcccacaaaaacaagcacactgtcacgatgcaaatcagcgtgattccccaccagaaaggaagcttgtacatttgcagggtcacaccgcctccggcaatcatcaccatagtcgtcgaaaacaaataaaaaatgatgaggaaatcataaattttcgccagccatggccccattaaatgctccagaaccggcagaaaatgagtggattgaaccttaaaactgattttcatcacaatataagacgagaaaatgaacataattgtaaacagcacaatagcaagtccgctttccgccccaaaaaactgccatatctcctgaccgctcgcatatccggccccgatcaggctccctaatatgagcagcatccacttcattccggctctccacaacactatcacctcatagacaaagttcagcttgttcccgttattgttactatataaataaaggaaagcaaacatgccatattttcatagacatttgaacacaagctgaaattatgatacgaaatacacataaaaaaagactgctaatacggcagtctaaaaagagatatttatttgtttgtccgcggaatgaagaagtgaacttcactcttcacttttttctaaccattcctatctattcaagtgtttcataagcagaccattgcttgatcatgatcgaggcaatgggggacaatacttgtaatcgcccactaaccattcatatcatgccctctacttttttaaattctccggtgccatacacaaagcataaaaaatcatactgctggatatactgtaaacaaccttacataactacacacaccatagcaattctgttacctactataacaaggaagtgaaacccatgaatcgaaaaggcgggcttttttcttctcaggaacgagtaaagcaatatgtttcacatacagatgctgcagcggcaaaacaaatccaaaccatcctttcttcatccttacgtaaagctgctggcaaaccaattgtcgtggtttgtatcggaacagaccgttcaaccggtgactcattaggcccgctcgtaggaatgaaactcaaacagatgcagctcaccagattccatgtctacggaaccttatctgaccccgtccatgctgtgaacatgaaggataaaatcaatgacattcataaattacataaaaacccatttgttatagcagtggatgcatgcttaggccgcgttaagagtgtgggttcatttcaaatcggggacgggccattaaagcccggagccggtgtacaaaaagaccttcctgaagtgggagatcttcatattaacgggatcgtgaatgtgagcggtttcatggagtattttgtattgcaaaatacaagactcaacttggtcatgaatatggcaaatgttctagcggaaggcttgagtttaacagatcggacagagtggaggcaagaacgccttaacccgctgcaaaggctcactgggcgcatataaatgaaaaaaccatcttcgtttgaaagatggttttttcatttatgattctctttcagacaaaagctctaaaatccggtcaaggtcttcattagagaaaaattcaatttcgattttgccttttttcttctgtcttttaatattaactgttgttccaaaataattttggagataggattctcgttcttttagaaccgcatctttcacaggttcttttttctttgtttcacgtggaacattctgatttaactgctgaatcagctgctcaagctggcgaacattgagctgctccgcaatcactttttgtaccagcggttcaagcttatttttgttttttaagccaagaagcgtgcgtccatgtcccatagaaagcgtaccttcggcaataagctgctgaatattttctggcagtgtcagcagtcttaaatgattcgcaatatgcggtctgcttttcccaagacgtttggcgagctgctcttgtgtgagatctaagtgtttcaacaaggagtcatatgcctgagcctcttcaagcggagataaatcttcacgctgaaggttttctaataaagcaatttccctcattaacacctctgataattcacggacaatggccggaactgtatctaaacctgccagctttgccgctcgaaaacgccgttcacccgcaacaatatcatagccttttaaagattttctgacgataagcggctgaagaatgccatgctgcagcacagattcttttagttcagctaatgcctcgtcatcaaagtgttttcttggctgataaggattagggcgtaaatcggcaattttaatttcttcaactgtctcttcagacaaatcgacctgattaaataacgcattaatcccttttccaaggcctttagccattcgcagccacttcctttgctaaatctaaatatacttccgcacctcttgaccgcggatcgtataaaatgatgggttttccgtgactcggtgcctcactcagacggacattacgcggaataactgtcttatatactttatctctaaaatacttcttaacctcttcaatcacttgaatgccaaggtttgtccgggcatcaagcattgtcagcaatacaccttcaatcattaaatcagtattcaaatgcttttgcacaagacgtactgtatttaataactggctgagaccctccaaggcataatattcacactgtacaggaatcacaacggaatccgaggcagtaagggcgttaatcgtcagcaagcccaatgacggcggacaatcaatgataatataatcataattttgctttactgcttcaagcgctctcttcaatctcacttctcttgatattgtaggaaccagctcgatctcagccccggcaagctgaatcgttgcaggaatcacatccaagttctctactgtcgttgctttaataatatctattacatctgcatcatctactaaaatatcgtacacacactgctctacatcggctttttcaatccctaatccgcttgtcgcatttccctgcggatcaatatctaccagcagaacccttttccctatgtaagccaaacatgccccaaggttgacagacgtcgttgttttgccgaccccgcctttttggttcgtaattgctatgatttttcccacgatgtcacctactttcacatgaacatgtactatcttgcttctattctatcaaaaaaagattaaagcgtttcatttttttcatcattttgttccgaatcagaagggaaataattgaaaattcaagcacgctttatgctttctcttataaattctgcaatttctatgtttttttgacttaaaaaaggaatttcttaaagaaaaaaagaagaagtcacagtacagaacgtggaaacaggatggtgagaaaatggtttatcaaacgaagagagatgtacccgttacgctgatggttgtgtttctcatattactgatacaagcagatgccattgttccttttgtgctgggaaatataagagtttccggctggatcatttttattctgctgactcttttaaatggactcatcatttggagctttattgacctaaaatatgtattgaaggaacaccatctgatcattaaagccggattgatcaaacatcaaattccttatgaaaaaatcgataaagtcgttcaaaaaaagaaactgtggtccggttttcgtctgatcggctctcgccatgccatcacaatatattatcaggggggatggggacatgcagtgatttcaccctaaaaatctgaagaatttatccacaagctcaaagaaaagaattctaatataacaatattcactaaaagtaagtgattaccttttattaaaaatataaaaagctctcctgcttttcaggagagcttctattttggtatgcgaatcgttaattgaatatattcttcaaattcttcttcttccgtattcaattttacaccgctgtcttccaccattgatagtgactggcgaatcgtgttcatcgcaattcttgtatctctgctgaatgctttgcgtctcggctttggctttctctggccttgctccagcattttcaccacgcggtcttctgtctgctttacatttaaacttttctcaataatctctgtgagcagtgtgacttggagctcaggctgtttcagcggaatcagtgctctggcatggcgctcggtgattttcttctccataatcgcctcttggaccggctgaggcagctttaataaccgaagcttattcgcgattgtagactgcccttttcctaagcgctgtgcgagtgcctcctgtgttaaatcatgcagctcaagcagcctagcataagcatgcgcttcctcgatagaagacagttcttcccgctgcaagttttcgattaacgccacagaagcggtttccgtgtcggaaaaatccttaataattgccggaatcttttcccactcaagcgattgcaccgctctccagcgtctttcacctgcaatgagttcgtattggccttcttcttctgtatgcctaacaacaatcggctgaataatgccgtgtgtatgaatggtcattgctaactctttgattttttcatctgagaaaatggtgcgtggctgaaaacggttgggaacgatagcatttaccggtatttccagaatctcttctttgtttgtatcatgttcagcaatctccggctcctgttccttctcaccaagcccgaagaaacgagagaatgaatgcttcatgtacctacaccacctttaaaaactgccatttttataattctattttctcatggtttttcctgctgtacatccatcaattttgatgaaaatatgatggtattgtcatatcaggctgtctaaattacccttcaattggcgatttattaggagttcccggttttcttggatacttcttaggcgtattttttattttgcgtatcaccataatattacgatcgctttcttcaataggcagcttaaaagaatggatattctcaagttctcctccaagcgtcgtgattgcttttttgcctgcattcagttcttcttcagctgatgcggcttttaaagcaacaaataaaccgtttttcttcaccagaggcaagcaaagctcactcaaaacagataatctcgcaactgctcgtgccgtcacaatatcatagctttcacgcacgtctttccgttgcccgaacgtttcagctctgtcatggcagaatgttgtattctccaattgcaaagcctcagatagcttttctaaaaacgtgatccgtttattcagtgaatctacgattgtgacattgaggtgcggaaagcatatttttatcggcagacttggaaaacccgctcccgctccgacatcacaaatcgtgttcacctgattgaagtcgacataaaaagcagctgtaatggaatcataaaaatgctttaaatacacttcttttttctctgttattgaagtcagattgattttttcgttccattcaaccagcatgtcgtaatacagctcaaattgctctagctgacggggagaaagggagatccctttttccgccaaaccagaagtaaattcttcaatattcatgccgtcatcctttctattcggctatcttcgcaatgcgtccctgctctaaatacaccaatagaattgaaatgtccgccgggtttacaccggaaatgcgggaagcttgggcaacagacaaaggccgtacatttttcagtttttgacgcgcctcggtcgcaatccccttaattgcgtcataatcaattcgatctggaatttttttattttccatcttcttcagtttttccacttgctgaagagatttttcaatatatccttcatatttcacttggatttctacttgttctgccacgtcttgaggaaccggcacttctggcggcgccagttttgtgactgtttcatagttcatttcaggacgcttcatcaagtctgtgccgcgaactccatctttcaattcgcttccgccaagagaacggatatattcttgattttccggagacggcttgataattacagaatgaagacgttttttctccgcctcgatcgccgcttttttcttctcaaaagccgcatagcgctcatcagaaatcaatccaatgcggtgtccgatttctgtcagacgcaaatcagcattgtcatggcgaagcagcaatctgtattccgcacgtgatgtcaaaagacgatatggctcattggtaccttttgtcacaaggtcatcaatcagaacaccaatataggcgtcagaacggcttaaaatcacttcttcttttccaagcgcttttcgtcctgcattgattcccgccataatcccttgtcccgcagcttcttcataaccggaagttccgttaatttggcctgcagtgtaaaggtttgtgattttttttgtttcaagtgtcggccagagctgtgtcggtacgattgcatcatactcgatcgcatagccggctctcatcatttgcacgttttcaagtccaggaatcgttgcaagcattctttgctgtacgtcttctggaagacttgtagataaaccttggacatagacttcctgtgtatttctgccttccggctcaaggaagatctggtgacgcggtttatcattaaatcgtacaactttatcttcaatggatgggcagtatcttgggcccgtacctttgatcataccggaatacatcggtgaacggtgcaggttgctgtcaataatctcatgtgtctcagggcttgtatatgtcagccagcaagggagctgatctgtgatatattccactgtttcatatgagaaagcgcgaggcacatcgtcaccaggctgaatttccgttttgctgtaatcaatcgtgtcgcttttaacgcgaggcggcgtacctgttttaaaacgaacaaggtcaaaaccgagttcctccaaatgctcagaaagcttaatagaaggctgctggttattcgggccgcttgagtaagacagatcgccaagaatgatacgtcctcttaaatatgtccctgttgtcatgacaactgctttcgcacgataatgtgcgcctgtttgtgtaataacgcctcggcattcgccgtcttcaacgatcagccgctccacaattccttgcagcaatgttaagtttggttccttttcaagcgtatttttcatttcgtgctgatattggaatttgtctgcttgcgcacgcaaagcacgaaccgcaggaccttttcctgtattcagcattctcatttgaatatgcgttttatcgatgtttcttcccatttctccgccgagcgcgtcaatttcgcggacgacaatcccttttgcggggccgccgacagacggattacatggcataaatgcaaccatatctaggttgatggtcaagacaagcgttttggcgccttggcgtgcagatgcgagggcagcctcaacaccggcatgcccggcgccaatcacaatcacatcgtattggcctgcttcataccccatgattctagttcctcctttaattattttcctaaacagaattgagaaaagagctgatcaattaagctttcgtggacagaatctccaatgatttcccctaaaagctcccagcatcttgtaaggtcaatttgcaccatgtcgatcgggacatcctgttcgatgccgctaagcgcatcttcaatggcgcgttttgcttgctgtaaaatagagatgtgacgcgtgttgctgacataagtcagatccccgctttcaatagcacccgtgtagaacagcgattgaattgcttcttccagatcattaatgccttcctcttttaaaagagaagtcgtaacaactggacgtccattggcaagctcacggacacgttcagtgtcaatcttcgcctcaaggtcagtcttattcaaaatcacgataacatccatgccctcaacggcttcaaaaagcttcacgtcttcttcagaaagctcttcactataattaagcacaagtaaaatcaggtccgcttcctttagaacctggcgagaacgttcaacaccgattcgctcaacaatatcctctgtttcacgaatacctgctgtatcaaccagacgaagcgggacgccccttacattcacgtattcctcaatcacatcccgtgtcgttccgggaatatcagttacaatggcttttgcctcatgaacgaggctgttcagaagagatgattttcctacgtttggccggccgataatgacggtagaaagaccttcacgcaagatttttccttgctcagaagtcctcagcagcgcctcaatttcctttttcacggcggttgccttttcgactaaaatctgatgcgtcatttcctctacatcatcatactccggataatcgatattcacctcaacatgggccagtgtttctaaaatctcactgcgcaaacggcgcaccaaagcagaaagacgcccttccatttgattcatagcaacgttcattgcccggtccgttttcgctctgattaagtccataaccgcttccgcctgtgaaagatcgattcggccgtttaaaaacgcacgtttcgtaaattcgccaggctctgccagtctcgctccctctctcaatgcgagctgaagcacttggttcacagtcacaattcccccgtgacagtttatctcgataacatcttcccgtgtaaaagttctcggcgcttttaacactgataccattacttcctcaacgacacgatccgaaggtctgtctacgatatgaccataatgaatcgtatgtgattcgaccgagctgagtgttttccccttcggtcccttataaattttatctgcgatttgaatggcttctggtccgctcaaccgtacaatcgcaatcgcgccttctcccatcggtgtggaaattgccgcaattgtatccatgttgttcacctctctttacttatacttcatctatataaaaaaatttttattatgccaaaactaaaagataacatagtttggttcgaagtggaagatttgttatccacagaaatagaaattcgtcccttattactttaacttatccacatgtgaataacaattaattttatttcctgaacttcctttttatcaacaggatacacctaaaaagaaaaaacttaaacggcaaaaccttgatattactaggaaaagtagatttttcggatacaaaaaaaccgaaatccaatttttatcggacttcggttttatgctatcttttatgggaaataacgagatgacgattttcgccttcacccattgaatatgttttgatctggtggtttgcatatccagaaagagtatcgtgaataatttttctttcgctggacggcataggctcaagctggatggattttttcgttttcaaaacctggtcagcaagcttgatggccagctggctcagtgtttcttttcttttcaaacgatagttttctgcatccaccgtcacatttttgtattggcctggataacggttaagggcaagctgtgtcaaagtttcaagggcgtttaaggtttgtcctcttttcccaatcaacaatgctgccttttcacctgttatatgatatctcactgtctttttgctttcttgaacagtcacatcagacttcccggcaatggcttcggcgatcgtttgaagatataacttcgcttgctgaatcggatcaatcttttcaaccagctttacgatcgcaggctttttgccgaaaatgccgagaaaccctttgtttccctcttcaataacagtaatttctaccttatccttcgttaatcccagctcttgcaatccggactgtactgcttcatcgacatttcgccctgcagcagtcacattcctcactttttctttcctccggctttttgcggctcaggattttttttaatatcaggtcctttaatgaggaaagtttgcgcaatcataaacaagttaccgactacccaataaagagaaagagccgccgggaagttgatcgcaaatacgataatcataattggcataatccaaagcatcatcgccatttgcggattttgctgcgcattgccagccatcatcagtttttgctgaacaaatgtagcgacaccggcaacgataggaagaatatagtaaggatctttttctcctaagtcaaaccataagaagctatgctctgaaatcgcctgggttctcatgatcgcatgatagaatccaattaaaatcggcatctggatcaaaatcgggaaacatcccgccaatggattgacaccatgcttttggaataaagccattgtttcctgttgaagcttttgctgcgttttttgatcctttgagctgtatttttctttaagcttttgcatttccggctgtaaagcctgcatcgctttcgaacttctcagctgcttaatcatcagcggtaaaattaataaacgaattaaaatggtaactagaataattgaaagcccgtagttatctcccgtcaatttcgctacatacgtaatgagctcagacaatggatatactacgtacttgtcccagaaatgcggactatctgcagtgatcggctctttcacactcgagcatccagccaaaagcatgaatacgccaaccatacttaatagcaaccctattctccttttcaacaacatttcctcctataattaatctttacactcttttattgcaaagcatacttgtatgtattttagcatctttcagttttaaatggtgtctttttctgatcaaccagaaaggaagcgcttttaaaagttgtaagaaagcagtggtgatgcctactttgacgaagatttcttatataatgaagactttctgaatagatgctgcagactttttttcgtttcctcatatgtcagctggctcgccggttttctggcaataatgatgtaatccttttccttcagtctctctttctcttcaagaaaggcctgccgaatcaaacgtttgatccgatttcgcatcacggcattgccaatttttttgctgacggaaagcccgacacgcagttcatcattttcaggctgatcaagcgtatataagacaaactggcggtttgcaactgatgtcccatgtttaaacactttttgaaaatcttcatttttctttaaacgatttcgcttcttcaaatgactcactccgatactggctggcagaaacttttaaaatttattatgaacatgagatgcatctgaaccaggaagcatgccccggttcattacgcatcacatctatcttttcccataacgtgaaaaaagaccactgacattattcagtggcctaagctgataatacttttctgcctttgcggcgacggcgtgctaaaactagacgaccgttttttgaactcatacggcttctgaagccatgaactttgctgcgtttacggttattcggttggaatgttcttttcatttatgacacctccctcgaggaatagctgttaaagacagtcttacttattatatttgcgttacctattcattgtcaacttcactagtgcttttatttcttgcaaccataataggataccataccttttcaactttcgaaaccttattttttagattccttaattttacggaaaaaagacaaattcaaacaatttgcccctaaaatcacgcatgtggatatctttttcggcttttcttagtatccacagaggttatcgacaacattttcacattaccaacccctgtggacaaggttttttcaacaggttgtccgctttgtggataagattgtgacaaccattgcaagctctcgtttattttggtattatatttgtgttttaactcttgattactaatcctaccttccctctttatccacaaagtgtggataagttgtggattgatttcacacagcttgtgtagaaggttgtccacaagttgtgaaatttgtcgaaaagctatttatctactatattatatgttttcaacatttaatgtgtacgaatggtaagcgccatttgctctttttttgtgttctataacagagaaagacgccattttctaagaaaaggagggacgtgccggaagatggaaaatatattagacctgtggaaccaagcccttgctcaaatcgaaaaaaagttgagcaaaccgagttttgagacttggatgaagtcaaccaaagcccactcactgcaaggcgatacattaacaatcacggctcccaatgaatttgccagagactggctggagtccagatacttgcatctgattgcagatactatatatgaattaaccggggaagaattgagcattaagtttgtcattcctcaaaatcaagatgttgaggactttatgccgaaaccgcaagtcaaaaaagcggtcaaagaagatacatctgattttcctcaaaatatgctcaatccaaaatatacttttgatacttttgtcatcggatctggaaaccgatttgcacatgctgcttccctcgcagtagcggaagcgcccgcgaaagcttacaaccctttatttatctatgggggcgtcggcttagggaaaacgcacttaatgcatgcgatcggccattatgtaatagatcataatccttctgccaaagtggtttatctgtcttctgagaaatttacaaacgaattcatcaactctatccgagataataaagccgtcgacttccgcaatcgctatcgaaatgttgatgtgcttttgatagatgatattcaatttttagcggggaaagaacaaacccaggaagaatttttccatacatttaacacattgcacgaagaaagcaaacaaatcgtcatttcaagtgaccgaccgccaaaggaaattccgacacttgaggacagattgcgctcacgttttgaatggggacttattacagatatcacaccgcctgatctagaaacgagaattgcaattttaagaaaaaaagccaaagcagaaggcctcgatattccgaacgaggttatgctttacatcgcgaatcaaatcgacagcaatattcgggaactcgaaggagcattaatcagagttgtcgcttattcatctttaattaataaagatattaatgctgatctggccgctgaggcgttgaaagatattattccttcctcaaaaccgaaagtcattacgataaaagaaattcagagggtagtaggccagcaatttaatattaaactcgaggatttcaaagcaaaaaaacggacaaagtcagtagcttttccgcgtcaaatcgccatgtacttatcaagggaaatgactgattcctctcttcctaaaatcggtgaagagtttggaggacgtgatcatacgaccgttattcatgcgcatgaaaaaatttcaaaactgctggcagatgatgaacagcttcagcagcatgtaaaagaaattaaagaacagcttaaatagcaggaccggggatcaatcggggaaagtgtgaataacttttcggaagtcatacacagtctgtccacatgtggataggctgtgtttcctgtctttttcacaacttatccacaaatccacaggccctactattacttctactattttttataaatatatatattaatacattatccgttaggaggataaaaatgaaattcacgattcaaaaagatcgtcttgttgaaagtgtccaagatgtattaaaagcagtttcatccagaaccacgattccaattctgactggtattaaaattgttgcatcagatgatggagtatcctttacagggagtgactcagatatttctattgaatccttcattccaaaagaagaaggagataaagaaatcgtcactattgaacagcccggaagcatcgttttacaggctcgcttttttagtgaaattgtgaaaaaattgccgatggcaactgtagaaatcgaagtccaaaatcagtatttgacgattatccgttctggtaaagctgaatttaatctaaacggactggatgctgatgagtatccgcacttgccgcagattgaagagcatcatgcgattcagatcccaactgatttgttaaaaaatctaatcagacaaacagtatttgcagtgtccacctcagaaacacgccctatcttgacaggtgtaaactggaaagtggagcaaagtgaattattatgcactgcaacggatagccaccgtcttgcattaagaaaggcgaaacttgatattccagaagacagatcttataacgtcgtgattccgggaaaaagtttaactgaactcagcaagatcttagatgacaaccaggaacttgtagatatcgtcatcacagaaacccaagttctgtttaaagcgaaaaacgtcttattcttctcacggcttctagacgggaattatccagacacaaccagcctgattccgcaagacagcaaaacagaaatcattgtgaacacaaaagaattccttcaggccattgatcgtgcatctcttttagctagagagggacgcaacaacgttgtaaaactgtccgcaaaaccggctgaatccattgaaatttcttccaattcgccagaaatcggtaaagttgtggaagcaattgttgcggatcaaattgaaggtgaggaattaaatatctcttttagtccaaaatatatgctggatgcactaaaggtgcttgaaggagcagaaatacgcgtaagctttacaggcgcaatgagacctttcttaattcgcacgccgaatgatgaaacgattgtacagcttatcctccctgtcagaacctattaatccgatacactgctgccgacctgtcggcagcttttctattcggtatctgctccgacaagttttccctttccctaattcgtttttttttagtacaattagatattagtgatatttgaaagaggtcgatataatggcaaatccgatttcaattgatacagagatgattacactcggacaattcttaaaattagccgatgtgattcagtctggcggtatggcgaagtggtttttaagcgagcatgaagtgcttgtgaacgatgagccggacaaccgccggggcagaaagctgtatgttggagatgtggtagagattgaaggatttggttcatttcaagtcgtcaattaaagcgggtgacactgattgtatatccagaacttagaactgacatcttaccgcaactacgaccatgctgaacttcaatttgaaaataaagtaaatgtgatcatcggagaaaacgcccaggggaagacaaacctcatggaggcgatctatgtcttgtccatggcgaaatcgcaccggacatcaaatgacaaagaacttatacggtgggacaaagactatgctaaaatagagggaagagtgatgaagcaaaacggggcgatcccgatgcagctcgtcatctccaaaaagggtaaaaagggcaaggtcaatcatattgaacagcaaaagctcagccagtatgtcggggccctcaacaccattatgttcgcgccggaagatttaaatcttgtaaagggaagccctcaagtgagaaggcggtttcttgacatggaaatcggacaggtttctcccgtctaccttcatgatctttctctttaccagaaaatcctttcccagcggaatcattttttgaaacagctgcaaacaagaaaacaaactgaccggacgatgctcgatgttctgaccgatcagcttgtagaagttgcagcaaaagtcgtcgtaaaacgcctgcagtttacagcacagctcgagaaatgggcgcagcccatccatgcaggcatctcaagagggcttgaagaactgacgctgaaataccatacagctcttgatgtatcagatcccctagagttgtcgaaaataggagatagctatcaagaagcgttttctaaattaagagaaaaagaaattgagcgtggtgtgacgctgtcagggcctcatcgcgatgatgttcttttctatgtgaacggacgcgatgtgcagacgtatggttctcaaggacagcagcgaacaacggcgttgtcccttaagctggcggagattgacctgatccatgaagaaatcggagaatatcccattttactattggatgatgtactgagtgaactggatgattatcgccagtcacacttgcttcatacgatccaaggccgtgtacaaacgtttgtcacaacgacaagcgttgatggcattgatcacgaaaccttacgtcaagcaggaatgttccgtgtgcaaaatggtgcgttagtgaagtgaagaaatgaggtgagcaattgtatattcatttaggtgatgactttgtggtttcaacacgagatattgtcggcatttttgactttaaagccaacatgtcgcctattgttgaagaatttctgaaaaaacagaaacacaaggtggtgccttccgtaaacggcacgcccaaatctatcgtagtcacggttcagaatatatattactctcccttatcttccagcacattaaaaaaacgtgcgcaatttatgtttgaaatagattcttagaaattttttatcacgaatatatcgtttagaaaagtgtaggtgaatgacgtggctatggaacagcagcaaaacagttatgatgaaaatcagatacaggtactagaaggattggaagctgttcgtaaaagaccggggatgtatatcggttcgacaaacagcaaaggccttcaccacctggtatgggaaattgtcgacaatagtattgacgaagccctcgccggttattgtacggatatcaatatccaaatcgaaaaagacaacagtatcacggttgtagataatggccgcggtattccagtcggtattcatgaaaaaatgggccgtcctgcggtagaagtcattatgacggtgcttcatgccggaggaaaatttgacggaagcggctataaagtatccggaggattacacggtgtaggtgcgtcggtcgtaaacgcactatcaacagagcttgatgtgacggttcaccgtgacggtaaaattcaccgccaaacctataaacgcggagttccggttacagaccttgaaatcattggcgaaacggatcatacaggaacgacgacacattttgtcccggaccctgaaattttctcagaaacaaccgagtatgattatgatctgcttgccaaccgcgtgcgtgaattagcctttttaacaaagggcgtaaacatcacgattgaggataaacgtgaaggacaagagcgcaaaaatgaataccattacgaaggcggaattaaaagttatgtagagtatttaaaccgctctaaagaggttgtccatgaagagccgatttacattgaaggcgaaaaggacggcattacggttgaagtggctttgcaatacaatgacagctacacaagcaacatttactcgtttacaaacaacattaatacgtacgaaggcggtacccatgaagctggcttcaaaacgggcctgactcgtgttatcaacgattacgccagaaaaaagggcttattaaagaaaatgatccaaacctaagcggagatgacgtaagggaagggctgacagcgattatttcaatcaaacaccctgatccgcagtttgagggccaaacgaaaacaaagctgggcaactcagaagcacggacgatcaccgatacgttattttctacggcgatggaaacatttatgctggaaaatccagatgcggccaaaaaaattgtcgataaaggcttaatggcggcaagagcaagaatggctgcgaaaaaagcccgtgaactaacacgtcgtaagagtgctttggaaatttcaaacttgcccggtaagttagcggactgctcttcaaaagatccgagcatctccgagttatatatcgtagagggtgactctgccggaggatctgctaaacaaggacgcgacagacatttccaagccattttgccgcttagaggtaaaatcctaaacgttgaaaaggccagactggataaaatcctttctaacaacgaagttcgctctatgatcacagcgctcggcacaggtattggggaagacttcaaccttgagaaagcccgttaccacaaagttgtcattatgacagatgccgatgttgacggcgcgcacatcagaacactgctgttaacgttcttttacagatatatgcgccaaattatcgaaaatggctacgtgtacattgcgcagccgccgctctacaaggttcaacaggggaaacgcgttgaatatgcatacaatgacaaggagcttgaagagctgttaaaaactcttcctcaaacgcctaagcctggactgcagcgttacaaaggtcttggtgaaatgaatgctacccagctatgggagacaaccatggatcctagttccagaacacttcttcaggtaactcttgaagatgcaatggatgcggatgagacttttgaaatgcttatgggcgacaaggtagaaccgcgccgaaacttcatagaagcgaatgcgagatacgttaaaaatcttgacatctaatcataaaaagccttatttccaataagaaataaggcttttttctgaacaagatcagatgcagcaatgcctgcaatacctatatattctagcaatttaatgtgtataatcataagtttattgatataatggagaatagtgaaatcgtattgaaggtcataatggacaatctactcccacatatttcatgtgatacttcagggaggttttttaatgagtgaacaaaacacaccacaagttcgtgaaataaatatcagtcaggaaatgcgtacgtccttcttggattatgcaatgagcgttatcgtgtcccgtgctcttccggatgttcgagacggtttaaaaccggttcatagacggattttgtatgcaatgaatgatttaggcatgacgagtgacaagccttataaaaaatccgcgcgtatcgttggagaagttatcgggaaataccacccgcacggtgattcagcggtatatgaatccatggtcagaatggctcaggatttcaactaccgttatatgctcgttgacggtcatggaaacttcggttctgttgacggagactcagcggcggccatgcgttatacagaagcaagaatgtctaaaatctcaatggagattcttcgtgacatcacaaaagacacaatcgattaccaggataactatgacgggtcagaaagagaacctgtcgttatgccttcaaggttcccgaatctgctcgtgaacggtgctgccggcattgcggtaggtatggcaacaaacattcctccgcaccagctgggagaaatcattgacggtgtacttgctgtcagtgagaatccggacattaccattccagagcttatggaagtcattccagggcctgatttcccgaccgcgggtcaaatcttgggacgcagcggtatccggaaagcatacgaatcaggccgaggctctgtcacgatccgggcaaaagctgagatcgaacaaacatcttcgggtaaagaaagaattatcgttacagagttaccttaccaagtaaataaggcgaaattaattgagaaaattgctgatctcgtaagggacaaaaagatagagggtatcacagatctgcgtgatgagtcagatcgtacaggtatgagaattgtcattgaaatcagacgcgatgccaatgcaaatgtcatcttaaacaatctgtacaaacaaactgctctacaaacatcttttggcatcaacctgcttgcacttgttgatggccagccgaaagttttaactcttaagcaatgcctggagcattaccttgaccatcaaaaagttgtcattagacgccgtactgcttatgaattgcgtaaagcagaagcgagagctcatatcttggaaggattgagagttgcactggatcatctcgatgcagttatctcccttatccgtaattctcaaacggctgaaattgcgagaacaggtttaattgaacaattctcactgacagagaagcaagcacaagcgatccttgacatgaggctccagcgtttaacgggactggaacgtgaaaagatcgaagaagaataccaatctcttgttaaattaattgcagagctaaaagacatcttggcaaatgaatataaagtgcttgagatcattcgtgaagaactcacggaaatcaaagagcgttttaacgatgaaagacgtactgagatcgtcacttctggactggagacaattgaagatgaagatctcatcgagagagaaaatatcgtagttactctgacgcacaacggatacgtcaaacgtcttcctgcatcaacttaccgcagtcaaaaacggggcggaaaaggtgtacaaggtatgggaacaaacgaagatgatttcgttgaacatttgatctctacgtcaactcatgacacgattctcttcttctcgaacaaggggaaagtgtatcgtgcaaaagggtatgaaatccctgaatacggcagaacggcaaaaggaatcccgattattaacctgctggaggtagaaaagggtgagtggatcaacgcgattattccagtcacggaattcaatgcggagctttaccttttcttcactacaaagcatggggtttcaaaacgaacatcgctatctcaattcgctaatatccgcaacaatggtctaattgctctgagtcttcgtgaagatgatgaactgatgggtgtacgtctgactgacggcacaaaacaaatcatcattggaacgaaaaacggtttactgatccgtttccctgaaacagatgtccgagagatgggaagaactgcggcaggcgtaaaaggcatcaccctgacggatgacgacgttgttgtcggcatggagattttagaggaagaatcacacgtccttatcgtaactgaaaaagggtacggaaaacgaactcctgctgaagagtacagaacccaaagccggggcggaaaaggactcaaaacagcgaaaatcaccgagaacaacggccaactagtagcagtgaaagctactaaaggtgaagaggatctaatgattattacagctagcggcgtactcatcagaatggacatcaatgatatctccatcaccggacgtgtcactcaaggtgtgcgtctcatcagaatggcagaagaagagcatgttgctacagtagctttagtagagaaaaacgaagaagatgagaatgaagaagaacaagaagaagtgtgaaaaaaagcgcagctgaaatagctgtgctttttttgtcataaccctttacagtcataaaaattatggtataatcatttctgttgtctttttaaagacacaagcatgaccattatgactagtaaaaacttttttaaaaaagtattgacctagttaactaaaaatgttactattaagtagtcgcttcgagagaagcacacaaagttctttgaaaactaaacaagacgaaacgtacctgttaattcatttttttataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttaggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggaactttgttccttgaataagttaagatgggcctgtagctcagctggttagagcgcacgcctgataagcgtgaggtcggtggttcgagtccactcaggcccaccatcttatataacggggccttagctcagctgggagagcgcctgctttgcacgcaggaggtcagcggttcgatcccgctaggctccaccaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacacctctctaaaggcggaaggtaaggaaactccgctaagggctctcacatcctgtgagaaacgcccagtaccttcatcctgaaggcatttgtttggtggcgatagcgaagaggtcacacccgttcccataccgaacacggaagttaagctcttcagcgccgatggtagtcgggggtttccccctgtgagagtaggacgccgccaagcaagtttaaacccagctcaatgagctgggttttttgtttgttaaaaatgaagaagaaactgtgaagcgtatttagggaatttcttttctgatactaataaaaactgctgaattaacacgtagtcatcacttatatgctgtgttaataactcataccaccattccgtttcataccttgcaatcatcccaacgttgtacaaaatcaaataatgaattgtcatttcgggaagcctcagaaattgctccctttgagaagggatataatattggttcttttccatgtcaaacaataagctgatcgatgtccatggctccttgtcttgtggtgaaatttcgaacagcagcccgtgttcatttttttttgtaaaagaccattgataatgatgggacatgtattcagcaaaccttgaatcagacattttgtaattgattactacttcctccggtacaaaaatttcgttcttatccttctcaacttttgtcataaatcgttctttctgctgaaagtagaaaatatcgctaagttctggaatggccattaataattttttcatggtataccgttcatctactatatccgattgtccgaataaatgtttcataaaatgtacgcataggccattccgttgtattttcacttcatcatcgctaaaacaataattttgtttctttcgttttcttgttgttacgccatgtgccagtaccgatgtatggcttggataatgaggatcacgtgtaattaagcatgctttgataagctgtgccattccataaaataaaagaatcggtttgatttctaagggagaatatgcggcttgtttataaaacgattcggcatgctttaagaaataaataaaccgttcactgtttttaaaagagttttttttcgcatcgtcaataccgtttaagatataaaccttttctagaaatttctgggttgattcaacggagtaaaatagcgctaagtctttccactcatgatatgtcatgtatatttcttaatcctttccgttatctaaatatttcaactctttcccgcttccttgacatgctcttggctagttgataatctacatataatattttgccgaaaagagggggatttactaatgtgggaaagtaaattttcaaaagaaggcttaacgttcgacgatgtgctgcttgtgccagcaaagtctgaggtacttccgcgtgatgtggatttatctgtagaacttacaaaaacgttaaagctaaatattcctgtcatcagcgcaggtatggacactgtaacagaatcagcaatggcaattgcaatggcaagacagggcggcttgggcatcattcacaaaaatatgtccattgaacagcaggctgaacaagttgataaagtaaagcgttctgagcgcggcgttatcacaaatcccttctttttaactcctgatcaccaagtatttgatgcggagcatttgatggggaaatacagaatttccggtgttccgattgtaaataacgaagaagaccagaagcttgttggaattattacaaaccgtgaccttcgctttatttctgactactcaatgaaaatcagcgacgtcatgacgaaagaagagctagttactgcatctgtaggaactactctggatgaagctgaaaagattttgcagaaacataaaattgaaaagcttcctctcgtagacgaccagaataaattaaaaggtcttatcacaattaaagacattgaaaaagtcattgagttcccgaactcatctaaagacattcacggccgcctgatcgttggcgcggcagttggtgtaactggcgatacaatgactcgcgtcaaaaagcttgttgaagccaatgttgatgtgattgttatcgatacagctcacggacactctcaaggcgttttaaacacagtcacaaaaatccgtgaaacgtatcccgaattaaacattattgctggaaacgtggcaacagctgaagcgacaagagcgcttatcgaagctggagcagacgttgtcaaagttggaataggacctggctcaatttgtactacacgtgttgtagccggcgtcggtgttccacaaattacagcaatttatgattgtgcgactgaagcaagaaaacacggcaaaacaatcatagccgacggtgggattaaattctctggcgatatcactaaagcattggcagccggcggacatgctgttatgctcggaagcttgcttgcaggcacatcagaaagccctggtgaaactgaaatctaccaaggcagaagatttaaggtataccgcggcatgggatcagttgctgcaatggaaaaaggaagtaaagaccgttacttccaagaagaaaacaaaaaatttgttcctgaaggaattgaaggacgcacaccttacaaaggaccagttgaagaaaccgtttatcagctagtcggaggccttcgttctggtatggggtattgcgggtccaaagatctgcgtgcgctaagagaagaagctcagttcattcgcatgactggcgcaggacttcgcgaaagccatccgcatgacgtacagattacaaaagaatcacctaactatacaatttcataataaattgttacaaattaaaaacatttgacagggtctctgactctgtctattttttttatactgattatgataaaatttatactgttgtgcattgaaaatgtccttaacggcttaattatagatgaagaaaatgaaatacggaggtcgtacgattgaacatcaagaaatgtaaacagctactgatgtcattggttgtgttaactctagctgtcacgtgtctggctccaatgtcaaaagcaaaagcagccagcgatccaattgatatcaatgcatctgctgctattatgatcgaagcttcttcaggtaaaattctttacagtaaaaatgcagataagagactgccaattgcgagtatgacaaaaatgatgacagagtatctgttattggaagcaattgatcaaggtaaagtgaaatgggaccaaacctatacgcctgatgactatgtgtatgaaatttcccaagataacagcttatcaaacgttcctcttcggaaagacgggaaatacacagtaaaagaattatatcaagctacagcaatttattctgcaaatgctgctgctattgcgattgcagaaatcgttgccggttctgaaactaagtttgttgaaaaaatgaatgcaaaagcaaaagaactaggcttaacagattacaaatttgttaacgcaacaggtcttgaaaacaaagatcttcacgggcatcagcctgaggggacaagcgtaaatgaagaaagtgaagtttctgcaaaggatatggcgattcttgcggatcacttgattactgattaccctgagatactggagacttccagtatcgccaaaacgaaattccgagaaggcaccgatgatgaaatggacatgccgaactggaattttatgctgaaggggcttgtcagcgagtataaaaaagcgactgtagacggactgaaaacaggttctactgactctgcgggttcatgctttacaggaacagctgaacgcaacggtatgcgtgtcatcactgttgttttaaacgcaaagggcaaccttcatacaggccgtttcgatgaaacgaagaaaatgtttgattatgctttcgacaatttctccatgaaagaaatttatgctgaaggcgatcaagtaaaaggccataaaacaatttcagttgataagggtaaagagaaagaagtaggcattgtgacaaacaaggcgttctctcttcctgtcaaaaatggtgaagaaaagaattacaaagcgaaggtcacactgaataaagacaacttaactgctcctgtgaaaaaaggaaccaaggttgggaagctgactgcggaatacacaggtgatgaaaaggattacggattccttaacagcgatctggctggcgtagaccttgttacaaaagaaaatgtagaaaaagcaaactggtttgttttgacaatgcgcagtatcggcggattttttgccggaatttggggaagcattgttgatacggtaaccggctggttttaatcaattgaaagagctctgatggatgttagggctctttcgcgtaatatactgaaaaaacccaatttttaataaaaaatgattttcaaagcgctaaaaaccgaataaaatagtatatatccatatgaattattggatttctaggatacaataaggattagaaatcatataactataccttgattagggggaccaagaaatggctcaaacaggtactgaacgtgtaaaacgcggaatggcagaaatgcaaaaaggcggcgtcatcatggacgtcatcaatgcggaacaagcgaaaatcgctgaagaagctggagctgtcgctgtaatggcgctagaacgtgtgccagcagatattcgcgcggctggaggagttgcccgtatggctgaccctacaatcgtggaagaagtaatgaatgcagtatctatcccggtaatggcaaaagcgcgtatcggacatattgttgaagcgcgtgtgcttgaagctatgggtgttgactatattgatgaaagtgaagttctgacgccggctgacgaagaatttcatttaaataaaaatgaatacacagttccttttgtatgtggctgccgtgatcttggtgaagcaacacgccgtattgcggaaggtgcttctatgcttcgcacaaaaggtgagcctggaacaggtaatattgttgaggctgttcgccatatgcgtaaagttaacgctcaagtgcgcaaagtagttgcgatgagtgaggatgaactaatgacagaagcgaaaaacctaggtgctccttacgagcttcttcttcaaattaaaaagacggcaagcttcctgtcgttaactttgccgctggcggcgtagcaactccagctgatgctgctctcatgatgcagcttggtgctgacggagtatttgttggttctggtattttcaaatcagacaaccctgctaaatttgcgaaagcaattgtggaagcaacaactcactttactgattacaaattgatcgctgagttgtcaaaagagcttggtactgcaatgaaagggattgaaatctcaaacttacttccagaacagcgtatgcaagaacgcggctggtaagaacataggagcgctgctgacatgttaacaataggtgtactaggacttcaaggagcagttagagagcacatccatgcgattgaagcatgcggcgtggctggtcttgtcgtaaaacgtccggagcagctgaacgaagttgacgggttgattttgccgggcggtgagagcacgacgatgcgccgtttgatcgatacgtatcaattcatggagccgcttcgtgaattcgctgctcagggcaaaccgatgtttggaacatgtgccggattaattatattagcaaaagaaattgccggttcagataatcctcatttaggtcttctgaatgtggttgtagaacgtaattcatttggccggcaggttgacagctttgaagctgatttaacaattaaaggcttggacgagccttttacagggtattcatccgtgctccgcatattttagaagctggtgaaaatgttgaagttctatcggagcataatggtcgtattgtagccgcgaaacaggggcaattccttggctgctcattccatccggagctgacagaagatcaccgagtaacacagctgtttgttgaaatggttaaggaatacaagcaaaaggcacttgtataaaacagttgaaagctgtggaaacttatagtacattataagcacaaataaagatcgaaaagcgttgataggaactagtagggagcctctctttctaagagagccgatggttggtgcgaatcggtgaaagatgctgtctgaatccatccttgagcgaaatgctgaaacaagtaggcatttacgggataaccgttatgtttgaaagtggaaaacgagtctttgatttgttttcaatcagggtggcaacgcgagagctctcgtccctttatggggatgagggctctttttattttcgacaaatcaataaaaaaaggagtgtttcgcatgcttgatacgaaaatgctgagagcaaattttcaagaaattaaagcaaagcttgtacacaaaggcgaagacttaactgattttgataagtttgaggcgctggatgatagacgaagagagcttatcggcaaggttgaagagttaaaaggaaaacgaaatgaagtttctcagcaggttgctgtgctgaagcgtgagaaaaaagacgcggatcacattattaaagaaatgcgtgaagtcggcgaggaaattaaaaagcttgatgaagaattgcgaacagtggaagctgagcttgatacaatccttctctcaatcccgaatattccgcatgagtctgtacctgtcggtgaaacagaagacgacaacgtagaagtgcgtaaatggggtgaaaagccttcatttgcttatgagccgaagccgcactgggatattgcggatgagctgggtattctggattttgaacgtgctgccaaagtaacaggaagccgtttcgtgttctataaaggcttaggtgctcgtctggagcgtgcgctttataactttatgcttgatctgcatgtggatgagtataactacactgaagtgatcccgccatatatggtaaaccgcgcaagcatgacgggaacggggcagcttcctaaatttgaagaggatgcatttaaaatcagagaagaagattatttcttaattccaacggcggaagtgccgattacaaacatgcatcgcgatgaaatcctttcaggtgacagcctgccgatcaactatgcggcattcagtgcttgcttccgttctgaagctggttcagcaggacgtgacacacgcggattaattcgtcagcaccaatttaataaagttgagcttgtaaagtttgtgaagcctgaagattcttatgaagaattagagaagcttacaaaccaagcagaacgggttcttcagctgcttgagcttccataccgtgtcatgagcatgtgtacgggtgacttaggctttacggctgcgaaaaaatacgatatcgaagtttggattccaagccaagacacatatcgagaaatctcttcttgcagcaacttcgaagcgttccaggcgagacgtgcgaatattcgattcagacgtgaagcgaaaggcaagcctgagcatgtacacacactgaacggttcaggactggcggttggaagaacagttgccgctatcttagaaaattatcagcaggaagacggaagcgttgtgattccgaaagtgcttcgtccttatatggggaatagagaagtaatgaaaccgtaaattatggaaaggcgtgcctgataaggtgcgcctttttgcttatgtaaacacggcattttcataaaaacaaaaaaagtttttaaaaatgcttgaccacacgagaacatacgtgatatagtaagtcttgtcgatacggaggaatacccaagtccggctgaagggatcggtcttgaaaaccgacaggggtgtcaaagcccgcgggggttcgaatccctcttcctccgccatattgattttaattctaatgaaacacaagcatatattggagattgttttgtccgttgcattcggtgcggcggattttttattttaaagaaaaagtgaatctcgactgagattcactttttttgattatcatgaataactgaagcaatttgatctacaatattttcaatcgagttttcgtcgttcagaagatcataatcttcaatgcgaagttttaaaacagggcaggcattaaaaccgcttatccagttctcgtagcgtgtatgcatttcttcccaataagacctgcttgtctgaagctccatctcacggccgcgttgttcaatccggtttaaaatgttctccagatctccttctaaatagatcaacacatctgggtgtgggaaatacggtgtcattaccattgcttcgaaaaggcttgtgtaagtcttataatcaacctttgacattgtccctttatcagcatgcatttttgcgaaaattcctgtatcttcataaatcgaacgatcctgtacaaaacctccaccggcttcaaaaattgttttctgttctttgaagcgttcagctaagaagtaaatttgaaggtgaaagctccaacgttcaaaatcatgatagaacttttccaaatatggattatgatcgacttcctccaacgatgttttaaatccaagccgtttagctaaagtttttgttaaagtcgattttccgacacctactgttcctgctactgtaataattgaattcttagggatatgatgttccttcatacgataagctcctttacatgggcggcaatgcgttcaaagtcgctcttattcaaaacgaaatcctttgaatcaccatctacggttaacactgtaagttcagggtctgcttcctgcagctgcttgatggcgacttcataatctgaaatcagctgctccaaatagctagtttcaatttttttctcaaaggggcgcccgcgtttttcaatgcggtgtagcaatgtaggcagactggcctttatgtaaatgatgaaattcggctttggcagatcatccgttagcaggtgatatatctttttgtatttttccagctgatgtggagacaaggtgcgttccgcaaaaatcacatttttataaatatgataatcagctattacaggctgtcccttttttaaaaagtgatcactggtgtcttcaagctgtttgtatctgtgacaaagaaaaaacatctcgagctggaagctccattcctctatattgtcataaaacttatcaaggtacgggttatcctctacaatctcattgatcatagggaatccgaattcttgtgagagcatcgttgcgagagttgtttttcctgccccgataggaccttctattgcaataaaaggggctgtattcatcggaatcctccttatatctgaaaaacgtgcgtcagttaccgaccttcatattgtatcacaacccttgggtgcccccatgaaaaaaagacgtttccaaattatcgaaacgtctttttgacaacattaaattgatcagacagcagcagccagttttgtggaaaggaaagacccagcttccaatagctgatgcctcttaaattcagctctttaatcagattgaattttgcttgaatcgagcgggcatcctcgaaccatacctcgtgccttctgttttctgcatcagtatagcggaagaaaggagcttgagcggtttggtcatactgaatggaagcattgttctgatcagctatgacaatggcttgctgagggcttacagctcttgccggagttccccctgctgtatatggcagcgtccagtcatatccatataaattctggcccatgacaattttgttcgcaggcatttcagtcaaagcatattctatgacatcacggacaggtccaattggagaaaccgcttgaggcggcccgccgctatagccccattcatatgtcatgagaacaacaaagtcgacaatttggccatgtgccctgtaatcatgagcttcataccatctgccctgctgtgttgcacttgttttaggagcaagagccgtagaaatttctaagccctctcgatggaaaagatcccttgcttcgcggaggaattgattataggcctctctatcctggggccgcaaatattcaaagtcgaaatgaatgtcacggaagccatatcttctggcattctcgactatttcatttagaagccgtctttttacagtttcgtcgttcaaaaggatccggccaagttcatcgctgaatgcttggttttctaggttcgtgataatcatcatcaatgttgtattttgactttctgtaatgctccttaaattcgttaaaggcggtgcgactaaggttccgttccgctgtgcctggaagctgaatgcgccaaggtacgttaagtagggcgacgcttctctggccgcctgctggagattttcgctgacttgatttcctcggggctccaaataagcatttgattcgatgtctcgtttaggagatggtgggatgtataaacggaaaccaatctgaagcacggtatttaactggatgcggttaacccttgcgagctcggctgccgttgtattgaactgccgggcgatggatgtcagggtatcacctcgcttcacatcatagaactggccggctattggaatgacaatggtttgtccgacaacaaggctgtcgggattcggtatttcattcgtttcagcgatctcatttgcggttgttctgtattgtgaagcgatagcagaaagagtgtcgccttgttttaccacataaatttgaatgaaaaacgcctcctttcatatcgctatcaatgtatgaaagaaaagcgctgatcatgtttatttttctgtaatttgttcttccgtcgtaatttctgcgaaaagaacattctccatcatagttaaggcgaattcgttatcttcgtcactgtttgacgcgatacagtccttaggaatcgtgatgctgtattccctcatataagcgtcattagcagtaaacagcacacatatattgccggctatacctgttaagataatatgtctcacctgcaactcagtaagaagggtgtgaagtgcagtttcgtagaaagcggaatgtttcggtttgattaaaaaataatcagcatcttccggagctatctttgtgatgatatccttgcttctttcatttgtgcattcttgctgaatgtttttaatgtcagcttgccaaagtccataatgatcattgatgtaaataatcggccattcattttgtctcgcgtgctcctttaatgataaaatatgaggaacgattttttctgtttttttagcgagggtttctcccatatcgaattcaaaattattgatcatgtctacaatgagaagggctgtatctgctttggacaatcgacagtctcctttccgtttcagttatagttaatatgtagcctttttaggcaatgaaaaaactttgaaaagagagcttatccttatgacacaagatgaactttatatgaaagaagcaattaaagaagcgaaaaaggctgaagagaaaggtgaagtgccaataggtgcggtgcttgtcgttaatgatgaaattatagcgcgtgcacataatttaagagagactgagcaacgatctattgcccatgcagaaatgcttgtaattgatgaagcatgtaaggcactcggaacatggcggctggaaggtgcgactctttatgtgacgcttgagccatgtccaatgtgtgctggtgcagtcgtactttctcgagtggaaaaagtggtttttggcgcatttgatccgaaaggcggctgttcaggcacgctaatgaaccttcttcaggaggaacgctttaatcatcaggctgaagtggtgagcggtgtacttgaggaagaatgcggcggaatgctcagtgcgtttttcagagaactaagaaaaaagaagaaagccgccaggaaaaacttgtctgaatagtacggttgcaatttttaggggaaacagatatacttaagtgtgcatcgtaatagatgcaacataaaatttgatatttattttgccgtgctaagcggggaggtagcggtgccctgtacctgcaatccgctctagcagggccgaatcccttctcgaggttcgtttactttaaggcctgccttaagtaagtggtgttgacgtttgggtcctgcgcaatgggaattcatgaaccatgtcaggtccggaaggaagcagcattaagtgaaacctctcatgtgccgcagggttgcctgggccgagctaactgcttaagtaacgcttagggtagcgaatcgacagaaggtgcacggtaaatcaatcatcaaattttcagactcacctaacattaggtgagttttttgttatgtaaaaagagcttttggaatcgaaacaaggttcatgtataatgggaatgatgaataacggaggagggcaaacccgtgagttaccaagctttatatcgagtattcaggcctcagcgctttgaagatgtggtcggacaagaacacattacaaaaacgctgcaaaatgcccttttgcaaaaaaagttttctcacgcctatctgttttccgggccaagaggaaccggaaaaaccagtgcagccaaaatatttgctaaggctgtcaactgtgaacatgctcctgttgatgagccatgcaacgaatgtgcggcctgtaaagggataacaaacgggtcaatatccgatgtcatagaaattgacgccgcttctaataacggtgttgatgagattcgtgacattcgcgataaagtgaagtttgccccatcggccgtcacatataaggtatatatcatagatgaagtgcatatgctttctatcggcgcttttaatgcattactaaaaacattagaagagccgcctgagcattgtattttcatattagcaacaactgaaccgcacaaaattcctttaaccattatctctagatgtcagcgttttgactttaaacgaattacctcccaagcgattgtaggccgcatgaataaaattgttgatgctgaacagctgcaagtggaggaaggatcgctggatatcatcgcgagtgctgcagacggagggatgagggatgccctgagccttcttgatcaggccatatcattcagcggcgatatcctgaaagtcgaagatgcgcttttaattacgggtgctgtttctcaattatatatcgggaagcttgcacaatccctgcatgataaaaacgtttctgacgcactggaaacattaaatgaattgcttcagcaaggaaaagatccagctaagctgatagaagatatgattttctatttcagggacatgctgctgtacaaaacagcccctggcttagagggagtgcttgagaaagtaaaagtcgatgaaacgttccgggaactaagtgaacaaattccggctcaggccctatatgaaatgattgatattctgaacaagagccatcaggaaatgaaatggacaaatcatccgcgtatctttttcgaagtggccgttgtaaagatttgccaaacctcacatcaatctgctgctgatctcccggaagtggatatgctgatgaaaaaaatccagcagcttgaacaggaagtagagcggctcaaaacaacgggcataaaagcagctgcggaaagcccgaaaaaagaagcgccgcgtgtgccaaagggcgggaaatccaattacaaagcgccagtaggcagaattcatgagattttgaaggaagccacaagaccggatcttgatctgctcagaaacagttggggcaagcttcttgctcatctcaaacagcaaaacaaagtatcacatgccgctttgctgaatgacagtgaacctgtggctgccggatcggcggcatttgttctgaaattcaaatatgaaattcattgtaaaatggtcgctgaggataacaacggagtccggactaatcttgaacagattttagaatcgatgctcggaaaaagaatggatttgattggcgttccagaagcacaatggggtaaaataagagaagaatttttagaagatcatcagcaggaaaatgaaggatcaaatgtaccggctgaagaagacccgcttattgccgaagcgaaaaagcttgttggagcggatttaattgaaataaaagactaacaaaatgaaagagagtgaatgctatgcgtggcggaatgggtaatatgcaaaaaatgatgaaacaaatgcaaaaaatgcaaaaggacatggcgaaggctcaagaagagcttgcagaaaaggttgttgaaggaactgcaggcggcggtatggtaacagtaaaagcaaacggccaaaaagaaatcctggatgttatcatcaaagaagaagtcgttgatcctgaagatattgatatgcttcaagatttagtgcttgctgcaacgaatgaagctttgaaaaaagttgacgaaatcacaaacgaaacaatgggtcaatttacaaagggaatgaacatgccaggtttattctagggggataaaagaacatgcaatatcctgaaccaatatcaaagctgattgacagctttatgaaattgccagggatcggaccgaaaacagcggttcgtctggctttttttgttctaggtatgaaagaagatgtagtattagattttgcgaaagcattagtaaatgcgaaacgcaacctgacatattgttcagtttgcgggcatattacagatcaggacccttgctatatatgtgaagatacgcgcagggataagtctgttatctgtgttgtgcaagaccctaaggatgttatcgctatggagaaaatgaaggaatacaacggacagtatcacgttcttcacggcgctatttctccaatggacggcatcggaccggaggatattaaaataccagaattgttaaaacgattacaggatgatcaagtgacagaagtgatcctcgcgacaaaccctaatatagaaggggaagcaacagcgatgtatatatcaaggctcctcaagccgtctggtattaagctctcccgtattgcccacggactgcccgtcggcggtgatttggaatatgctgatgaggtcactctttctaaagcacttgaaggaagacgtgaattgtaaggaggaaaaagcgatccatgggttttcttcgcaagaaaacattaagaagagagtttgatgaaaaactaaccgagcagctttttaaacaaaaggaagagtggaacaggcaaaaaaagctggttgaaaaaagcttagaaccgtctgctgaagtgttatacgaactgaaagtagctgaagcgaagtattttttttacttaagggaagcgaagcagcgaaatttaaaaatcagccggtggaagtaagtggtctaaactcctggatcttctcataagcttgtactagaacaagcgaaggagatgagaagattcatggagcctatttttattattgggattattttaggactggttattcttctttttttatcaggttcagctgcgaagcctttaaagtggattggcatcacagctgttaaatttgtggcgggcgctttgctgctggtttgtgtaaatatgtttggcggcagtcttggcattcatgtgccgattaatctggccacaacagctatcagcggaattttagggatacccggaatagctgcgttagtcgttattaagcaatttatcatttaattgatattatgtattgacttagacaactgaagatgttattctaatatacgtcgctgatgacgaacagcttttttgaaaagaaaatgctaaaaagttgttgacagtagcggcggtaaatgttatgataataaagtcgcttaaacgagcggtaaacaaagttctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggaactttgttccttgaataagttaagatgggcctgtagctcagctggttagagcgcacgcctgataagcgtgaggtcggtggttcgagtccactcaggcccaccatcttatataacggggccttagctcagctgggagagcgcctgctttgcacgcaggaggtcagcggttcgatcccgctaggctccaccaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcgggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaagcttaaacccagctcattgagctgggttttttgtttactcaagatcgagaaaatcaaacaaatacaaacaccgagggcttatacagcccatatactgatttcaagtttcgaaaagatctaaatagtgtatacaatatccgttttaagggaggctaattgtacggaggtggagaagatggacgaaacagttaaacttaatcatacatgtgtgatttgtgatctagagaagaatagaggcattcatctttatacgaaattcatatgcttagattgtgagagaaaagtaatttctacatcaacttctgatcctgactatgcgttttatgtaaaaaaactaaagagcattcatacaccgccattatattcatagacctgaaaaggtctttttttgtactcttaataataaaaagaagatgaaacttgtttaaggattgaacgtagtagataataatattaaaactgagtatagacacaggagtcgattatctcatgcagagattttttcactttttgatgtggagtttaactagcagtgcgacttttgttttcattggaatattgagcttttttggtttaaaccagtcgctttttttatctattgtttatgggcttgcttctggagcagccgtatatatagctggcatctggaatgcaagacggttatttcttaaaaagcatgaattgacaggaagagagtatgcttacattaagaaaaacttagaggaagcaaggcagaaaatgatccgtcttaggaaagccttgtttcaggctaaaagcattcaaatgtttaagcaaaatgcagaaatgctaaggattgtgagaaggatttatctcctcaccaaaaaagagccaaagcggttttatcaggcagaacgatttttttatcaaactctcgattcggttgttgaattgacagagaagtatgcttttctatcatctcacccaaaaaaaagcaaagaactgtcgatgtcgttaagtgagacacgcatcactcttactgaattgaccaagcgtttagaggaagatttaactcaggcaatggatgatgaaattgacgagttgcagtttgaattagacgcagcaaaacattcattaaagaaataagggaagagggtaagagcgatgaaccgagaccaaagcgaccttcatatagatgaattattggcagatccttttggtggtaacatagagataccaggttcggaggctgtaaaagcagagaaagagcaagtacggcttgttgatgttcttcctgaggaaaacaaggaaaaagcaattcagcttgctggacagattgatcataaaaatatgcaaagcattgtcttatacggttcacaagctcaatctaaactgctgaacttttctcatgatatgattaatcatgttcaaaagaaggatgtcggggagattggcgaaatacttggagagctgatgaaaaagctggagcaagtaaatcctgatgatctccaatctaagaaaaagggtattttggcacgcatgtttggaagagtatcaagttctcttcaagaggtgctgtctaaataccaaaagaccagtgtgcagatagacagaatcagcttgaagctggagcactctaaaaatgctttaatcagtgacaacaagctgttagagcagttatatgaaaaaaataaagaatattttgccgcgctgaatgtttatattgctgcaggagaactgaagctggaggaattaaaaacgaaaacaattcctgaactgaagcaacaggctgaatcgagtgatcataaccaaatggccgttcaagaggtgaatgatttaattcaatttgctgaccggttagataaaagggtgcatgatttgttgctgagcaggcaaattacaattcaaagtgcaccgcaaatcaggctgattcaaaatacaaaccaagcgttagctgaaaagattcagtcatccattgtgacagcgattccgttatggaaaaatcaagttgccattgcgctgacgcttttaaggcagcgcaatgcagtggatgcacaacagaaagtatctgatacaaccaatgagcttttgctgaaaaatgcggagcttttaaaaaccaatacaattgaaactgcacgggcaaatgaaagaggccttgttgatatagataccttgaagaaggtgcaggaaagcttaataagcacgcttgaagaaacactgactatacaagaagaaggacgaatcaaacgccgtcaggcagaagaagagctcatgatgatggaaggcgacctgaagcaaaagctgcttacaataaaggaaagatagttaccagtaagtctggctttaagttctgtcagaggcacgatataataaggtgtaagaagacacattcaaaggattgttttcatgaacacacctttatataaagcattaattcaacatgcgagaagaaattctcattcatttcatgttccgggacatcacaatggagatgtcttttttgatgacgctaagtcaatattcgatccgcttctcaccattgatgtaactgaactggcaggactggatgatctccatcatccttccggggtgattaaggaagctcaggagcttgtcagtcaattatatggatcggcggaaagtttttttctggtaaatggtacgactgtcggaaacttagcgatgattttatctgtttgtgaacctggtgatacaattctggttcaaagaaactgtcataaatctgtatttcatgctgttgatttggccggtgctgagccggtttatcttgcacctgacgttgattcagcgatgcatgtgcctacgcatgttccgcttggaacaattaaagaggccctggaagcatatccagatgcgaaaggcttggtactgaccaatccgacatattacggacatagtgctgatttgactgagatcattactgaagcccatcattacgggattcctgttttggtcgatgaagcgcatggcgcacattttattttaggtgagccttttccggtctcagctttaaaaatgggggcagatattgttgttcagtcggcccacaaaacgttgcctgccatgacgatgggttcttatttgcatctcaacaccagctgcaggattaacagggatcgggtggcagagtatttaaaccgattacaaagcagcagcccgtcttatccgattatggcttcgttagatattgcccgcgcttatgtacagcatattatagaagaacaaaagctttctgacattctgcagcggatacaaacacttaaacaaacgtttgattcacttacaaatgcagaagctgttaaccctgctaatccactgatcatcatggacccgctgaagctcacaattcgttcaaaacgcgggcattctggctatacgctgcaaagcatattagagcgtgccaacatattcactgagcttgctgatgaaaatcaagttctgctcgttctcccattaggaggaaaacggagaataaatgctgaaaccattagaagcatcgatgaagagattgagaaaacgcctccggatcagacgtttgtttctgcagaatggggtgtgcagcctgttactgtcttgccttatccaaaaaaggtcttacattcgtttaagaaagaatatgtgagctttgaggaagcagctggccggctgaatgcagaagatatcatcccttatcctccgggtatcccgatgattatggcgggagaaagaataacaaaagaaagtgtgcaaaaactcagccgcttgatcagcatgaaaacgcatgttcaagggaatatgaaaatcaaagagaaacaactacttgtttatatagaagaggagaaatcatgagcggtttatttattacattcgaaggtcctgaaggtgcaggaaaaacgactgttctgcaggagatcaaaaacatactgacagcagaaggccttcaggttatggcaactcgagagccaggcggaatagatattgcagaacaaattcgagaggttattctgaatgagaacaatacattaatggacccaaaaacagaagctctcttatatgcggctgcaagacgccagcatttagttgaaaaagtaaaacctgctttagaacaggggtttatcgttctttgcgacagattcatagacagttctcttgcgtatcaaggatatgcaagaggacttggaattgatgaggttctgtccattaatgaatttgccattggagatatgatgccccatgtaacggtttatttttcaattgatccggaagaaggactgaagcgtatttacgcaaacggctcacgggagaaaaacaggctcgatttagaaaaactggactttcatacaaaagtacaagaaggttatcaagagctgatgaagcgatttccggaaagatttcattcagttgatgccgggcaatccaaagacctcgtcgttcaggatgttctaaaggtgatcgatgaagcgttgaaaaaaattcaattgtgacctgtttcccaatagttgatataataatgtaaacgagatcacgttgtttccaatctaaaggaggccttcacagatgaaattgatagtggcagttgtacaagatcaggacagcaacagacttttgaaaaccttaacggatcacaacttcagagtcacaaagcttgcgacgacaggaggatttcttaaatcaggcaatacaacgtttatgatcggtgtcgaggatatacgcgtcaataaagcgttgagtctcattaaagaaaacgggcagaaacgtgatcagatgattgcccctgtatctccaatgggcggaaatgctgattcctatgtcccttatccagtcgaagttgaagttggcggagcgacagtatttgtccttccagtcgatgaatttcatcaattttaaggatctgaaactgtgaaaattaataaagatatacgtacatttatagataataagcagattccctctgtgaaaacatctgagatcacatcatcgtttaaaacatcaatggaaaaccaaagcagcaaaatgaagcttgatcagcttaccaggctattatctgatatagaggcattcggaaaaaggctaacgaaatctcggaattttaaagacttagcgagatttaaaggccttgtgaaacgttttgtcaaagaagctgtggacagcggcctttcacatgaaacatcgaaaagctttgacctttacgggaacagcagaacgctgggacttgtgaaagaaatagatgacaaattgatacagcttacggaagagatgatggatcaggaaaaaccggcaattgatttgctggagcgtattggcgaaataaaaggtttattaattaacctttacacatagagagtgatacaatggcaatatcctggaaggaaatgaacgagcttcagcccagagtgatgaagcttttatataatagtattgagaaggacagactatcacacgcttatttgtttgagggaaaaaaaggaacaggcaagcttgatgccgcgctgcttcttgcaaaaagcttcttttgtctggaggatggcgcggagccttgtgagagctgccgaaactgtaaacggatagagtcagggaaccatcctgatctccatcttgttcagcctgatggcttatcaatcaaaaaggcgcaaattcaagcgctccaagaagagttttctaagacaggacttgaatcgcataaaaagctgtatattatttcgcacgcagatcaaatgacagcaaatgcggcgaacagcctgctgaaatttttagaagaaccgaacaaagacacaatggccgtcctcatcactgagcagccccaaaggttattggataccatcatttcaagatgccaaacccttccttttcagcctttgcagccgaaagcaattgaagatagactgatcgaacaggacgtctcgcctcatatggcaaggcttctggccaacatgaccaataatgtagcagaagcagtcgaattaagtcgaaatgatgagtttgcagagtctagagcgaaagtgataaaattgtatgaagtcctacaccagcggaaaggacatgcttttttctttattcaagatcaatggatgccctttttcaaagaaaaaacccatcaagaaatgggtcttgatatgctcttattgatatatcgtgatgtgttgtccatccaaataggaaatgaagataaattgatttatcaagacttattccaatcaataaaacagcatgcgctacaatcaacacaacaaagcgttacgaatcagatacttgctgttttagaagcaaagaaacggcttcattccaatgtgaatgtacaaggattaatggagcacttggtgttaatgttgcaggagggataagcttgtacaatgtaattggtgtccgctttaagaaagcgggtaaaatatattattttgatccgaatggatttcatatagaacatgacagctgcgtaattgtagaaactgtcagaggcgttgagtacggccaggtcgtaattgcaaataaacaggtggatgagcatgatgtggtgcttccccttcgaaaagtgatacgtgtggctgacgagcgcgatcttctcattgtagaagaaaataaacaggaagcactatcagcatttgatatctgccaaaagaaagtgattgagcatggcttggatatgaagctggtcgatgttgaattcacgtttgatcgcaataaagtcattttttacttcactgctgacggccgagtcgactttagagagcttgtaaaggatttggcttctatctttaagacaagaattgagctgcgccaaatcggagtgagggatgaggcaaaaatgctcggaggaatcggtccttgcggaagaatgctttgctgttcaacgtttcttggagattttgaacccgtttccattaaaatggccaaggatcagaacttgtctttaaatcctacgaagatttcgggtctttgcggacgattgatgtgctgtctaaaatatgagaacgatgagtatgagacggcaaaagaacagcttccggatataggagaaatgataacgacagcaaacggtcccgcgaaggtcgtcggactaaatattctggaacgggtgcttcaggtggaactgataaaccgtgaaaaagtgatagaatatacttgggaagagctcttggaagagggcgtcgtatccgcacaaaccacagattaacgaggtgtggaaccttggataaaaaagagttatttgatacagtcattaacttagaagaacaaattggttcactgtaccggcagctgggggatttgaagcagcatatcggtgagatgattgaggaaaatcatcatttacagcttgaaaacaagcatttgcgcaaacggctggacgatacgacgcagcagattgaaaagttcaaagctgataaaaaagaatcaaaaacacagaagacagagcaaactgatataggggaaggatatgataatctggcacgtctgtatcaagaaggatttcatatctgcaatgtccactatggaagtgttcgaaaagaggattgtcttttctgtctgtcattcttaaataaaaaatagggaaaaggcttccgcataagacgggagcctttttcaaaggtactgaaaggataagaagatggtttcattacatgatgatgaaagattagactatttgctggcagaggacatgaaaatcatacaaagcccaacagtgtttgctttttcgttggacgctgtgcttctgtccaaatttgcgtacgttccgattcaaaaagggaaaatcgttgatttatgcaccggcaatggtattgtgccgctgctgctcagtacaagatcaaaagcagacattctgggagtcgaaatacaagaaaggctgcatgatatggctgttcgcagcgtggagtataataagctgcaggatcagattcagatcatacatgatgacctgaaaaacatgccggagaaacttggacataatcgatatgatgttgtcacctgcaatccgccgtattttaaaacaccgaaacaaactgaacaaaacatgaatgagcatctccgaattgcaagacatgaaatacactgcacactggaggatgtcatttcagtcagcagcaagctgctcaagcaagggggaaaagcagctcttgttcaccggccgggaaggcttctagagatttttgaactgatgaaggcttatcaaatcgagccaaaacgtgtacaatttgtctatccgaagcaagggaaagaagccaataccattttggttgaaggtatcaaaggcgggcgcccggatttaaaaattcttcctcctttattcgtttatgatgaacaaaatgaatatacaaaagaaatcaggaccattttatatggagacaaataaccatttcttctacgtcgtgaaatgtaaggacaatagctggtatgccgggtataccaacgatcttcataaacgagtgaaaacacacaatgatggaaagggcgcaaagtacacaaaagtaagacgtccggttgaattaatttttgccgagagcttttcaacaaagcgggaagctatgcaggcggaatattatttcaaaaaactaactcggaagaaaaaagagctttatatagaagaaaagcggaacaccaaggaggctgtatatgttaaggcgccaaatgagctttaatggaaagtcggacatgggaattctttacttggtcccaaccccaatcggaaatctagaggacatgacattccgggcgatcgacacgctgaaatcagtggatgcgattgctgcggaagatacgaggcaaacgaaaaagctttgtcatgtatatgaaattgaaacaccgctcgtcagctatcacgaacacaataaagaaagcagtgggcacaaaattattgaatggctgaaatcgggaaaaaacattgctcttgtcagtgatgccggtctgccgacgatttctgatcccggagcggaaattgtaaaggattttacggatataggcggttatgttgttccgttgccgggagcaaatgctgcattaacagctcttattgcttcaggtattgtaccgcagccttttttcttttacggttttctcaacagacagaaaaaagaaaagaagaaggagcttgaagcccttaaaaaacggcgggaaacgatcattttttatgaagcgcctcacagattgaaggaaaccttgtcagcgatggcagagatattaggagatcgggaaatcgctgtaacacgtgaactcactaagaaatatgaagagtttatccgaggaaccatatctgaggtcattggttgggcaaacgaggatcagatacgcggcgagttttgtcttgtcgtagaaggaagtaataatgaagaggtagatgaggaagaacaatggtgggaaaccctcactgcgaaagaacatgtcgagcattacatctcgaaaggcgctacgtctaaagaagccattaaaaaagcagcagtcgatcgcaatgtaccaaagcgtgaagtgtacgatgcttaccatattaagcaataaaaaaacgttcttgtgtcataacaagaacgttttttgtacaagaaatgattatttaaggttttgaagctggttttggatttcgctgatgatttgctcagcgccttctttactaagaaccaatttaccgcctgcaagtttaaggttatcatcagaaacttcaccagttacttggcaagtcatgtttggtttatattttttaaggatgattttttcatcatcaacatagatttcaagagcatctttttctgcgattccaagagtacgacgcagttcgataggaataactacacgtcctaattcatcaactttacgtacaataccagtagatttcataaacattctcctcccaagagatacttatttgtttaaattatatttttcttcgtcattattcgacaaaatccttaccttcatagcataacaaggtttccaataatcgtcaatcattttgtttactattgattgtaagaattagttcttatagtcagtaatgtcttagaaactaccgaaataacagcattttataaatatttaataaagctattatcctactaaaaatccttttaaatcaagactttcgaaccaaagttttttatttcatttgattatatacgacaaaattcgacacgaacagactttttttattttcattaaagatttttaattttaattattctttttcagggcgtatgtatatattcttgatcttaaaggctaagatggtatcatagataaaggataaatataaataatattcatatatgatttgcacttatcgccgctctcgtcctttgggcgggagctttttgacattctgattaggaggtttcaagatgccgcaagaaaacaatacattttacattacaacaccgatttattatccgagcggaaaattacatatcggccatgcatatacgacagtcgcgggagatgcaatggcacgttacaaaagattaaaagggttcgatgttcgctatttaacgggaacggacgagcatggacaaaagatccagcaaaaagctgaacaggaaaacattacacctcaggagtatgtggatcgcgcagcggcagatattcaaaaactgtggaagcagcttgaaatctcaaacgacgactttatccgcacgacagaaaaacggcataaagttgtcattgaaaaggtgtttcaaaagcttcttgataacggggacatctatcttgatgagtatgaaggctggtacagcatccctgatgaaacgttctacacggaaactcagctcgttgatattgagcggaatgaaaagggagaggtcatcggaggaaaaagccctgacagcggtcacccagttgaattgatcaaagaggaatcttatttcttccgcatggggaaatacgcggatcgtcttctgaaatactatgaagaaaacccgacattcattcagccagaatcacgcaaaaacgaaatgattaataactttatcaaacccggacttgaggatttggcagtatcacgtaccacttttgattggggcgtgaaggtgccggaaaatccaaagcatgttgtatatgtttggattgacgcactatttaactatttaacggcactcggttatgatacagaaaatgatgagctttatcaaaaatattggcctgccgatgttcatttagtcggtaaggagattgtacgattccatactatttactggccaattatgctgatggcgctggatcttccgctgccaaagcaagtattcgcgcatggctggcttttgatgaaagacggaaaaatgtcgaaatcaaaaggaaacgttgtagatccggttacattaattgagcgctatggtttagacgagcttcgctattacctgcttcgcgaagtgccgttcggatctgacggtgtattcacgccggaaggatttgttgagcggattaactatgatttagcgaatgatttaggaaatctattgaatcgtactgttgcgatgattaataagtattttgacggtcaaatcggttcttacaaaggtgctgttacggaatttgatcaaacgctcacttctgttgctgaagaaacagtgaaagcttatgagaaagcaatggaaaatatggagttctcggtagcactttcgactttatggcagctcatcagccgcacaaacaaatacattgatgagacagctccatgggtgcttgcgaaagatccggcaaaagaagaagaattgcgatcagttatgtatcacctcgctgaatcattgcgtatttcagcggtactgcttcagccattcttaacaaaaacacctgaaaaaatgttcgagcagctaggtattactgatgaatctttaaaagcttgggacagcattacagctttcggccagctgaaagatacaaaagtacaaaaaggtgatccattgttccctcgtttagaggcagaagaagaaattgcttacatcaaagggaaaatgcaaggttcagcaccatcgaaagaagaaacaaaagaagaagagccgcaagaggtcgatcgtttacctgaaattacgattgatcaattcatggatgtagagcttcgcgtagctgaggtcattgaggcagagccagtgaaaaaagcagaccgtttattgaagctgcagctcgatcttggttttgaaaagcgccaagtggtatccggcattgcgaagcattatacgcctgaagagcttgttggaaaaaaactcgtttgtgtaacaaatctaaaaccggttaaactcagaggagagctttctcaaggtatgatccttgcaggagaagcagacggcgttttaaaggtcgtgtctatcgatcagtcgttaccaaaaggcacaagaattaaataatgataaaacaaaaggtgtttcacgtgtaacaattcgtcgaacaccttttgtgtttcgacaagaaaggagtttttcacttatgttgtttgacacacacgcgcatttaaatgcagaacaatatgatactgatcttgaagaggttattgaacgggcaaaagctgaaaaagttgaacgaattgtcgtagttggttttgaccgtccgacgattacccgtgcgatggaaatgattgaggaatatgattttatttatgcagccattggctggcaccctgttgacgctattgacatgacagaggaagacttagcgtggattaaagagctttctgctcatgagaaagtggtagcgataggggaaatgggactggattatcattgggataaatcacctaaagatattcaaaaagaggtgtttagaaaacaaatcgccttagcgaaagaggtcaatttgcctattatcattcataaccgtgatgcaacggaggatgtcgtgaccattttgaaagaggaaggcgcagaagctgtgggcggaatcatgcactgctttacaggaagtgcggaagtggcaagagaatgcatgaaaatgaatttttatttatcatttgggggaccggtgacatttaaaaatgcgaagaaaccgaaggaagtagtgaaggaaattcccaatgaccggctgctgattgaaacggactgcccgtttctcacaccgcaccctttccgcgggaaaaaaaatgagccaagctatgtgaaatatgtggcagaacaaatcgccgaattaaaagaaatgacctttgaagagattgcgtcaatcacgactgaaaatgcgaaaagacttttccgtataaactgacaaaaaacgctagcgggttttgtaagagcttgtcccttacagcgtttttctataaaagttctacatgctttcttctcctcataggataggtttgtcgacaagtctttcttccgtttctcagtgtatttcaggataatgaagaagacactgagcttttgggagaaagagaagggagggttgacagccttttagatactctatataatctctccgaggagaaggaggcgtttttcatcacacaaaaaatgaaaaagctgttttccgtaaagcttagcaaaagcaaagtcattctggttgctgcttgtttgcttttggcaggaagcgggactgcgtacgcggctcatgagctgacgaaacaatcagtctcagtttctatcaatggcaaaaagaaacatatacgcacacatgcaaatacagtcggtgatcttttggagacgcttgatataaagacaagagacgaggacaagatcacacctgctaaacagacaaagataacagcagacatggacgttgtgtatgaggctgcaaaacctgtgaagcttacaataaacggggaagaaaagacgttatggtcaacagcaaaaacggtcggtgcattactggacgaacaagatgttgatgtgaaagaacaagatcaaattgatcctgcaatagatacagatatttcgaaagacatgaagattaacatagagcccgcatttcaggttactgtgaatgatgcagggaaacaaaagaagatctggacgacttcgactacggtcgctgactttttaaaacagcaaaagatgaacataaaagacgaagataaaatcaagcctgcgttagatgcaaagctgacgaaaggaaaggctgatattacaattactcgtatcgaaaaggtcaccgatgtagttgaagagaagattgcgttcgatgtgaaaaagcaagaagacgcttctcttgaaaaagggaaagaaaaggtcgtccaaaaaggaaaagaaggcaagctaaaaaaacatttcgaagtcgttaaagaaaacggtaaagaagtgtccagagagcttgtaaaagaagaaacagctgaacaaagcaaagataaagtgattgctgtcggcacaaagcaaagcagtccaaaagttgaaacggttagtgcttcaggtgattcaaaaacagttgtgtcccgcagcaatgaatcaacaggcaaagtcatgactgtatcatctacggcttatacggcaagctgcagcggttgttcaggacatacagcgacaggcgtcaatttaaaaaataatccgaatgccaaagtcatcgctgtggatccaaatgtcattccgctaggctccaaagtccacgtggaaggctatggatatgccattgctgcagataccggttcagcgattaaagggaacaagatagacgtctttttcccagagaaatcatcggcgtaccgatggggaaataaaacagtcaaaattaaaatcttaaattagtatatacttatgtattcagagggttttgcgccctctgtttttttcgttataatagacaaagtgcattttctgcttattagacgctcgacataagaaaaagtttcatgaatatacaaaagtttttattttgtcttggaggaaataatgaaaattaaagagatcattgtggtcgaggggcgtgacgatacggcccgcatcaaattggctgttgatgcagacacaattgaaacaaatggttcagccatcgatgatcatgtgattgaccaaatccgtttggcccagaagaccagaggcgtcattattttaacggatccggactttccgggagagaagattcgcaaaaccatctcagaggctgtacccggctgtaagcatgcatttttgccaaaacatcttgccaaacctaaaaacaagcggggaattggtgtggagcatgcatcggttgaaagcattagggcatgtttagaaaatgtgcatgaggagatggaagcgcagccgagtgacatttcagctgaggatttgattcatgccggactaataggcggacctgcggccaaacgccgccgggaacgactgggtgatctgttgaaaatcggctatacaaatggcaaacagcttcaaaaacggctgcaaatgtttcaaattaaaaaaagtgattttatgagtgcgctcgataccgttatgcgggaggaacagaatgaataaagatattgcgacaccgattagaacgaaagagatactgaagaaatacggtttttcttttaaaaagagcttaggacagaatttcttaattgatacgaacattttaaacagaattgtcgatcacgcggaagtgacggagaaaacaggtgtcattgaaatcggcccaggaatcggggctttaaccgaacagcttgccaagcgggcgaaaaaggtcgtggcatttgagattgaccagcgattattgccgattctgaaggatacactgtcaccttacgacaatgtcactgtcattcatcatgacgtgttaaaggctgatgtcaaatcggtcattgaagaacaatttcaagattgtgatgagatcatggtagttgccaaccttccttattacgtaacaacaccgattatcatgaaactgcttgaagaacatcttccgctgaaagggattgtggtcatgctgcaaaaagaagtggctgagcgcatggcggctgatccttcatctaaggaatacggctcgctttcaatcgcggtgcagttttatacagaagccaaaacggtgatgatcgttccgaaaaccgtatttgttcctcagcctaatgtcgattccgcagtcatccgtctgattctccgagacggcccggcagtggacgtggaaaacgaatcttttttctttcagctcatcaaggcaagctttgcacagcgccgtaaaacgctgctcaataacttagttaacaatctgcctgaaggaaaggcgcaaaaatcaacgattgagcaagtgctcaaagaaacaaatattgacggtaagcgccgaggtgaatccctgtctattgaggagttcgcagcgctgtctaacggattgtataaagcccttttctaaaagggctttttgttttgcgcaccacatggactgccgctacataggctagagaaggacctttcattcaatgataagaaaaacttggactcagcgaaaaaaggcgctttctcaaggctctttctttcatgatgaggcttagtctatgtgtggagtgaggaacgtgcaatttcaaataggggatatggtagccagaaaatcctatcagatggatgttttgtttcgaattataggaatagagcaaacaagcaaaggaaattcaattgccattttgcatggagatgaagtcaggctgattgctgattcggatttttctgatctggtggcagtgaaaaaggatgagcagatgatgcggaaaaagaaagatgagagcagaatgaatgagtcgctcgaattgctccgccaagattataagctgctcagagaaaagcaggagtactatgcgacaagccaatatcagcatcaggagcattatttccatatgccgggcaaagtgcttcatctggatggtgacgaagcatatctgaaaaaatgcctgaatgtctataaaaaaattggagtgccggtctatggcatccattgccatgaaaagaaaatgtctgcttctattgaagaattgctcgacaaatatcgacctgatatcctggtgatcacagggcatgatgcgtattcgaagcaaaagggcggcattgatgatttgaatgcgtacagacattctaagcactttgttgaaactgttcaaacagcccgaaaaaagatccctcacttagatcagcttgttatttttgcgggggcctgccaatcccattttgaatcactcatcagagcgggtgcgaattttgcaagttcaccgtcaagagtcaatattcatgcacttgatccggtatatatcgtcgcgaagatcagctttacgccgtttatggaacggattaatgtatgggaagtgctccgtaatacgctgacaagagagaaagggcttggaggtattgaaacaagaggagttctgagaattggtatgccttataagtccaattaacagttgaaaacctgcataggagagctatgcgggttttttattttacataatgatacataatttaccgaaacttgcggaacataattgaggaatcatagaattttgtcaaaataattttattgacaacgtcttattaacgttgatataatttaaattttatttgacaaaaatgggctcgtgttgtacaataaatgtagtgaggtggatgcaatggcgaagacgttgtccgatattaaaagatcgcttgatgggaatttaggtaaaaggctgacgttaaaagcaaacggtggccgccgaaaaacgattgagcgttcgggcattttagctgagacgtacccttctgtttttgtgatacaactagatcaagacgagaactcgtttgaaagagtttcatacagttatgctgatattttgactgagactgttgagctgacatttaatgatgacgccgcaagctcagtggcattttaacgggcagtgaaccttttgtttactgctttttgttttgcccttttttggtttccagtaatttaaacgaaagttccatctgatttaacaaaagataaaacagtcacatattatcgtgacgtgcacgaatggctatcacttctaaaaaagggttgtttcgtttgggcagacgtcgtggagttatgtcagatgagtttaaatatgagcttgctaaagaccttggtttttatgacacagtaaaaaatggcggctggggcgaaattcgggctcgcgatgccggtaacatggtaaagcgcgctatagaaatcgccgaacagcaaatggctcagaatcagaataaccgataaggatgtgacccgggggacgtgctgttccctggtttttttattttggatataaatacataatgggctgaatatggatatgttcatcctgtacttcaaatgtgatacaatgttcatacttatgtttagatggagaagtaggtgaaagctatgcgtattttagaaaaagcgccagctaagatcaatctgtcacttgacgtcacccgaaaacgcccggatggctatcatgaagtcgaaatgatcatgacgacaattgatttagctgatcgaattgaattgacggagcttgcagaggatgaagtgagggtttcctcccacaaccgatttgtgcctgatgaccaaagaaacttagcttatcaggctgccaagctgatcaaggacagatacaacgtgaaaaagggagtttccatcatgattacgaaggtaattccggtggctgccggtcttgccggcggaagcagtgatgcggcggcgacactcagagggctgaacagactttggaatttaaatctgtctgcggaaacgcttgctgagcttggagcggaaattggctctgacgtttcattttgtgtctatggcggaactgcattagcaacagggcgcggcgagaaaattaaacatatcagcacgcctccgcactgctgggtcattttagcgaagccgacaatcggtgtttcaactgctgaagtgtacagagcgttgaaactggatggtatagagcatcccgatgtacaaggcatgatcgaggcgatagaagaaaagagttttcagaagatgtgcagccggttaggcaatgtgcttgaatctgttacactcgatatgcatcctgaagttgcgatgatcaaaaaccagatgaaacgctttggtgcagatgccgtgttaatgagcgggagcggcccgacagtatttggactggttcagtatgagtcgaaggtgcagagaatttataacgggttaagaggcttctgcgatcaagtttatgcggtgagaatgatcggcgaacagaacgctcttgattaaatccgtatgttaagttatattgatcttaaaatattcggattttgggggtaagttcatgaagtttcgtcgcagcggcagattggtggacttaacaaattatttgttaacccatccgcacgagttaataccgctaacctttttctctgagcggtatgaatctgcaaaatcatcgatcagtgaagatttaacaattattaaacaaacctttgaacagcaggggattggtactttgcttactgttcccggagctgccggaggcgttaaatatattccgaaaatgaagcaggctgaagctgaagagtttgtgcagacacttggacagtcgctggcaaatcctgagcgtatccttccgggcggttatgtatatttaacggatatcttaggaaagccatctgtactctccaaggtagggaagctgtttgcttccgtgtttgcagagcgcgaaattgatgttgtcatgaccgttgccacgaaaggcatccctcttgcgtatgcagctgcaagctatttgaatgtgcctgttgtgatcgttcgtaaagacaataaggtaacagagggctccacagtcagcattaattacgtttcaggctcctcaaaccgcattcaaacaatgtcacttgcgaaaagaagcatgaaaacgggttcaaacgtactcattattgatgactttatgaaagcaggcggcaccattaatggtatgattaacctgttggatgagtttaacgcaaatgtggcgggaatcggcgtcttagttgaagccgaaggagtagatgaacgtcttgttgacgaatatatgtcacttcttactctttcaaccatcaacatgaaagagaagtccattgaaattcagaatggcaattttctgcgtttttttaaagacaatcttttaaagaatggagagacagaatcatgacaaaagcagtccacacaaaacatgccccagcggcaatcgggccttattcacaagggattatcgtcaacaatatgttttacagctcaggtcaaatccctttgactccttcaggcgaaatggtgaacggcgatattaaggagcagactcatcaagtattcagcaatttaaaggcggttctggaagaagcgggtgcttcttttgaaacagttgtaaaagcaactgtatttatcgcggatatggaacagtttgcggaagtaaacgaagtgtacggacaatactttgacactcacaaaccggcgagatcttgtgttgaagtcgcgagactcccgaaggatgcgttagtcgagattgaagttattgcactggtgaaataataagaaaagtgattctgggagagcccgggatcacttttttatttaccttatgcccgaaatgaaagctttatgacctaattgtgtaactatatcctattttttcaaaaaatattttaaaaacgagcaggatttcagaaaaaatcgtggaattgatacactaatgcttttatatagggaaaaggtggtgaactactgtggaagttactgacgtaagattacgccgcgtgaataccgatggtcgcatgagagcgattgcatccatcacgctggatcacgaatttgttgtacatgatattcgtgtgattgatggaaacaatggtcttttcgttgcgatgccgagtaaacgcacccctgatggagagttccgcgatattgctcatcctattaattcaagcacgcgaggaaagattcaagatgccgtgttaaatgagtatcatcgtctgggtgacactgaagcattagaattcgaagaagctggagcttcttaaaaaataaccaaaaagcaaggactgctgaaagggctgacataagccttttgccggcggtccttttttaattctgatttttcaaacttagttgcactcaatagaaaattcttgcacttcatgaagtctccttgaaatcagaagatatttaggatatatttttctatggataaaagggatattggaggccaataaatggataagcggtttgcagttgttttagcggctggacaaggaacgagaatgaaatcgaagctttataaagtccttcatccagtttgcggtaagcctatggtagagcacgtcgtggacgaagccttaaaattatctttatcaaagcttgtcacgattgtcggacatggtgcggaagaagtgaaaaagcagcttggtgataaaagcgagtacgcgcttcaagcagaacagcttggcactgctcatgctgtaaaacaggcacagccatttcttgctgacgaaaaaggcgtcacaattgtcatttgcggagatacgccgcttttgacagcagagacgatggaacagatgctgaaagaacatacacaaagagaagcgaaagctacgattttaactgcggttgcagaagatccaaccggatacggccgcattattcgcagcgaaaacggagcggttcaaaaaatcgttgagcataaggacgcctctgaagaagaacgtcttgtaactgagatcaacaccggtacgtattgttttgacaatgaagcgctatttcgggctattgatcaggtgtctaatgataatgcccaaggcgagtattatttgccggatgtcatagagattcttaaaaatgaaggcgaaactgttgccgcttaccagactggtaatttccaagaaacgctcggagttaatgatagagttgctctttctcaggcagaacaatttatgaaagagcgcattaataaacggcatatgcaaaatggcgtgacgttgatcgacccgatgaatacgtatatttctcctgacgctgttatcggaagcgatactgtgatttaccctggaactgtgattaaaggtgaggtgcaaatcggagaagatacgattattggccctcatacggagattatgaatagtgccattggcagccgtacggttattaaacaatcggtagtcaatcacagtaaagtggggaatgatgtaaacataggaccttttgctcacatcagacctgattctgtcatcgggaatgaagtgaagatcgggaattttgtagaaattaaaaagactcaattcggagaccgaagcaaggcatctcatctaagctatgtcggcgatgctgaggtaggcactgatgtaaacctgggctgcggttcaattactgtcaattatgatggaaagaataagtatttgacaaaaattgaagatggcgcgtttatcggctgcaattccaacttggttgcccctgtcacagtcggagaaggcgcttatgtggcggcaggttcaactgttacggaagatgtacctggaaaagcacttgctattgccagagcgagacaagtaaataaagacgattatgtgaaaaatattcataaaaaataatcctaaattcggaggtttatccatgtctaatcaatacggagataagaatttaaagattttttctttgaattcgaatccagagcttgcaaaagaaatcgcagatatagttggagttcaattagggaaatgttctgtcacaagatttagtgacggggaagtccaaattaatatcgaagaaagtattcgcggatgtgattgttacatcatccagtctacaagtgaccccgttaacgagcatattatggaactgctgattatggtagatgcgttaaaacgcgcttctgcaaaaacgattaacattgttattccttattacggttatgcgcgtcaagacagaaaagcaagatcccgtgagccaatcacagctaaacttttcgctaacctgcttgaaacagccggtgcgactcgtgtgattgcacttgacctgcatgcgccgcaaattcaaggattctttgatataccgattgaccacttaatgggtgttccgattttaggagaatattttgaaggcaaaaatcttgaagatatcgtcattgtttcaccagaccatggcggtgtgacacgtgcccgcaaactggctgaccgactaaaagcgccaattgcgattatcgataaacgccgtccacgtccaaacgtggcggaagtcatgaatattgtaggtaacatcgaagggaagactgctatcctcatcgatgacattattgatactgcaggtacgattacacttgctgctaatgcgctcgttgaaaacggagcgaaagaagtatatgcatgctgtacacaccctgtactatcaggccctgcggtagaacggattaataattcaacaattaaagagcttgttgtgacaaacagcatcaagcttcctgaagaaaagaaaattgaacgctttaagcagctttcagtcggaccgcttctggccgaagcgattattcgcgttcatgagcagcaatcagtcagctatctgttcagctaaaccatttttcgaggtttaaatccttatcgttatgggtattgtttgtaataggacaactaaaacgacaataggatggtgctgaatatggcaactttaacggcaaaagaaagaacggactttactcgttcgtctcttcggaatatccgtacttcaggacatgttccaggtatcatatatgggaaggatacgggtaacaaacctgtgtcattagacagtgtggagctcatcaaaacgctgagggacgaaggcaaaaatgcagtcattacgcttgaggtcagcggagaaaaacactcagtcatggtaacagacctgcagacggacccgctgaaaaatgaaatcactcatgctgattttcaagtagttaatatgagtgaggacattgaagtggaagttccgattcatctgaccggagaagccattggagtgaaaaacggaggcgtactgcagcagccgttatatgcacttactgtaaaggccaagccaaaagccattccacaaacgattgaggctgatatttcaagcctcgatgtaaatgaagtactgacgattgcggatttgcctgctggcggtgactactcctttaatcatgaatcagatgaggttgtggcttcaatccttcctccgcagcagcaggaagcagctgaggtcaatgaagaggaatctgccgatgctcagcctgaaggtgaaaacgaacaataatagcttaaggcgtaaccctcccgcggttacgtcttttgtgctagaatgagaagaattatagcccgtttatgaagacgggagttatgtgactaagggaggattcgccatgcttgtgattgccggtctcggaaacccggggaagaactatgaaaatacacggcataatgtcggatttatggtgatagatcagcttgcaaaggaatggaatatagagctgaatcaaaataaatttaacggattatacggaaccggatttgtttccggcaaaaaggttctacttgttaaaccgcttacatatatgaatttatcaggagaatgtttgcggcctttaatggactactatgatgtcgataacgaagatttgacagtcatttacgacgaccttgaccttccgactggcaagatccgtttaagaacgaaaggaagcgccggagggcacaatggcatcaaatcactgatccagcatcttggaacatccgagtttgaccgtatccgcatcggaatcggccggcctgtaaacggcatgaaggtcgttgattatgtgttaggctcctttaccaaggaggaggcacctgagatcgaagaagcggttgataaatctgtgaaggcttgtgaggcttctttgagtaaaccgtttttagaagtcatgaacgaatttaacgcaaaggtataaaatgtaacaacaaagtccatactacaccaaaatgactttttcatcaggaggtcccttgtatggctttgcattattattgtcgtcattgcggagtgaaagtaggcagtctcgaatcttcaatggtatcgacagactcacttggatttcagcacttaacaaatgaggaaagaaacgatatgatttcttataaagaaaatggagatgtccatgttttgacgatatgtgaagattgccaagaggcgcttgaccgaaatccgcattaccacgaatatcacacatttattcaataaaaagctttggtgtagacactagaccaaagcgtttttctgttctcgcaggaaacagagaggaggggccatatggacaacattcaaacctttataaaagaaagcgatgactttaaatccatcatcaacggtttacacgagggcctgaaggaacagctgctcgcgggtctgtcgggttccgcgcgttctgtttttacttctgctctggctaatgaaacgaataagcctatctttctcatcacccataacttatatcaagcccagaaagtaacagatgatctgacttcacttctagaggatcggtctgtccttttgtaccccgtcaatgaactcatttcatcagaaatcgcagttgcaagccctgaattgcgggcgcagcgattagatgtcattaatagactaacgaatggagaagcgccaattgtcgttgctccggtagcggcaatcagaagaatgctgccgcctgttgaggtgtggaaaagcagccagatgctcattcaagtaggccgtgatatcgaacctgaccagcttgcctcacggctggtagaggtagggtatgagcggtctgatatggtttctgcgcccggggaattcagtattcgcggtggaatcattgacatttatccgttgacttcagagaatccggtgagaattgaactttttgacaccgaggtggattcaatccgcagctttaattcagatgatcagcggtcaattgagacccttacctcgatcaatatcggtcccgcgaaggaattaattatcagaccggaagaaaaagcgcgggcgatggagaaaatcgatagtagtcttgccgcgagcttgaaaaaattaaaagctgacaaacaaaaagaaatacttcatgcgaatatttctcacgataaagaacgcttgtctgaaggccagacagatcaggagctcgtgaagtatctctcatatttctatgaaaagcctgctagtttactagattatacacctgataatacacttctgattttggatgaagtcagtcggattcatgagatggaagaacagcttcaaaaagaagaagcggagtttatcacaaatcttcttgaggaagggaagattttgcatgacattcgtttgtcattcagcttccaaaaaatagtggctgagcaaaaacggcctctgctgtactactctttatttttgcggcatgtacaccatacgagcccgcaaaatatcgtcaatgtgtcaggccggcaaatgcagagtttccatggccaaatgaacgtgcttgcgggcgaaatggagcgttttaaaaaatcaaatttcactgttgtgttcttaggagcaaacaaggaacgtacacagaaattgtcatctgttttggctgattatgatatcgaggctgccatgacagacagcaaaaaagcgcttgttcagggacaggtctatatcatggaaggcgagctccaatcgggatttgagctgccgttaatgaagcttgccgttatcacggaagaagaactgttcaaaaaccgtgtaaagaagaagccgcgaaaacagaagcttaccaatgcagagcgcatcaaaagctattctgagcttcaaattggagattatgtcgttcatattaatcacgggatcggaaagtacctggggattgaaactcttgaaatcaacggcattcataaagactatttaaatatacattatcagggcagtgacaagctttacgtccctgtagaacaaattgatcaggtccaaaaatatgtcggctccgaaggaaaagagccaaagctgtataaattaggcggaagtgaatggaagcgggtcaagaaaaaagtagagacatccgttcaggatatagctgacgacttaattaagctgtatgccgaaagagaagcgagcaagggctatgcgttttctcctgaccatgagatgcagcgtgaattcgaatcggctttcccttatcaagagactgatgatcagctccgttcgattcacgaaatcaaaaaagacatggaaagagaacgtccgatggaccgcttgctgtgcggagatgtgggctacggtaaaacagaggttgccatacgtgccgcgtttaaggcgatcggtgacggaaagcaggtagctctgctcgttccgacaacaattttggcacagcagcattatgaaaccataaaagagcgcttccaggactatccgattaatatcggacttctcagcaggttcagaacgagaaaagaagcaaacgaaacaatcaaagggctgaaaaacggaacagttgatatcgtcatcgggacgcatcggctgctatcaaaggatgtcgtgtataaagatttagggctcctcatcattgatgaagagcagcgtttcggtgtaacccataaagaaaagatcaagcaaataaaagccaatgttgatgtattaacgttaacagcaacacctattccgcgtacgctgcatatgtctatgcttggcgtaagggacctttcagtcatcgagactccgccggaaaatcgcttccccgtacagacgtatgttgtggaatataacggcgctcttgtcagagaggcgattgaacgtgagcttgcacgcggaggccaggtctatttcttgtacaaccgggtagaggacattgagcggaaagctgatgaaatttcaatgctagtccctgacgcgaaggtagcatatgcgcatgggaaaatgacagaaaatgaattagaaaccgttatgttaagtttccttgaaggagaatcagacgttctcgtcagcacaaccattatcgaaactggcgtggacatcccgaacgtcaatacgctgatcgtatttgacgccgacaagatgggactttctcagctttaccagctgcgggggcgtgtcggccgttctaaccgtgtggcgtatgcgtacttcacgtatcgccgggataaagtgctgacagaagtggctgaaaaaaggctgcaggctattaaagaattcacagagctaggttccggttttaaaatcgcaatgcgtgacttaacgattcgcggagccgggaatcttcttggtgcccagcagcatggcttcatcgattcggtcggatttgacctctattcacaaatgctgaaggaggccattgaggagcgtaaaggagacacagcgaagacagagcagtttgaaacagaaattgatgtcgagcttgatgcgtatattccggaaacttatattcaagacggcaaacagaaaattgatatgtataaacgcttcaggtctgtggcgacaatcgaagagaagaatgagcttcaagatgaaatgatcgaccgctttggaaactatccaaaagaagtcgaatacttgtttactgttgcagaaatgaaagtctatgcgagacaggaacgtgtcgagctgattaagcaggataaagatgctgtcagattgacgatttctgaagaagcaagtgctgaaattgacgggcagaagctgtttgagcttggcaatcaatatggcagacaaatcggactgggaatggaagggaaaaaactcaaaatctccatacagacgaaaggccgtagtgctgatgaatggctcgacaccgtgctgggcatgctgaagggcttaaaagatgtgaagaagcaaaccatttcatcaacgtaaattttgttactctctggtgtatattacatttgatgtgacggatactaatttcaagcgaggcggaaggtacataaagtaactgctttaggtctttcccacatgtatataccatcaaatgaaagagaggcaccagagatgaaagcaaccggtatcgtacgtcgtattgatgacttaggtcgggtcgtgattcctaaagaaattcgaagaactctgagaatcagggaaggcgatccgcttgagatttttgtagatcgtgacggagaagtgattttgaaaaagtattctccgatcagtgagcttggagactttgcaaaggagtatgcagacgcgctttacgacagcctcggccattcagtgctgatttgtgatcgtgatgtatatattgccgtgtccggcagctccaaaaaagattacttaaacaagtcaatcagcgaaatgctggaaagaacaatggatcagcgcagctccgtgcttgagagtgatgcgaaatcagtacagcttgtgaatggaattgatgaggacatgaattcttatactgtcggcccaattgtggcgaacggtgatccgataggtgctgtggtgattttttcaaaagatcagacaatgggcgaagtagagcataaagccgttgaaacagcagctggatttttggctcgtcaaatggaacagtaggtcttattcctttcttcgaaaataggtatgtaaagaacagctctccttgggacgctgttctttttcatgcgtgcggaaaaaggaatccaagggttgggatgtggtataataacctcgtttttatttgtgccgcggtaatacgtgaaccgtattgcccctgacgttgggaaggagcttttggatggacgattcaataggcgttaaacggcattggatttggcagggggcttttgttttaattctggcaggcgtcatcacaaaaattttaagcgctgtttacagagtcccgtttcaaaacattgtcggcgatgttggattttatatatatcagcaggtatacccctttcttggtattgcggtcatgctgtccacatcaggatttccagtcattatttcaaagctgatgaatgattatagtgaaaaaaatcatcacaccatattaaaaatatcagcgttatttttgtctttaatcggtattttattatttctttgtttatatctgggtgctgttcctattgcactctttatgggggattcgcatctagccgtgttaattcaagtggccgcgtacgcgtttctgctgttcccatttgtcgcattgcttagaggcggttttcaggggcggcacgaaatgctcccttcagccttatcacagatgacagagcagtttctgcgtgttgcggtgctcttaggtttatcattttggctcgtgaaaaagggagcctcgctttatactgcgggagcggcagccgcttcaggctctcttgccggaagtttggttgcattgatgatactggggtttttttggtttaaaacgaatagagacaaccaaacggataggcaaaacgaaaatgtcatcacaacaaaagaattgacgaaaaaactgcttttatattcggttacaatttgtgtaagcagtttgctgcttttgtttatccagcttgttgatgctttgaatttatatgcattgctttcgggtggtgaggcaagcgaagaagcaaaacgcctaaaggggatctatgatcgggggcaacccttgctgcagctcggctcagtttttgctgtaagcattgcgacgtcactcgttccgtatatttctatggctgtaaaaaacaaagagctgaagatcatgaaagaaaaaatcacgtcatctttgaaactatgccttgtgctcggtacaggcgcatcggctgggttgatttgcattctaaagccggtaaatatcatgctgtttcaaaatggagaagggacaggtgcgttacaagtatttagctgctccattttatttgcatccttggcggtaacggcagcggcagtcttacagggagcgggatacacagtttttcctgcgatagcggtgggcgcgggtgttgcagtgaaatgggtgttaaacacacttttggttccgcgctatgggattgaaggcgcatcgcttgcgacagcggcttcctttgcggctgtcgccggccttaacttgtatcagcttcggcaaaaggaatggctcgataagcttagaggcgttttgattccgattattggatctgctcttttgatgtcagctgttttgcttgcgtatacgcgtctatggactttcttgtttcctgcaacaggaagaggagttgctgtgattgagagtctttctgctgttgcaattggtggcgcggtgtttatttattgtatgatgagattgggaatatttacagatgaagagctgaacagtgtgccattcggcagcaagttaagcaaattcatgagaaggagagaacaaaatggcgggtaaaattacagtcgtgggacttggtgccggagacatggaccagttgacaattggtatacacaagctgttgacgaaggcagatacgctgtatgtcagaaccaaggatcatcctttaattgaggagcttgaaaaagaaacgaagaacatccgtttctttgatgatatatatgagaaacatgatcagttcgaggcggtatatgaagaaattgctgatatcctctttgaagcggcgcggcgtgaggacgtggtttatgctgtgccgggacacccttttgtcgcagaaaaaacagttcagctgctgacggagcggcaggaaaaggaaaacgttcaagtgaaagccgcgggtggacaaagtttccttgatgccacattcaatgccttgcaaattgacccgattgaaggttttcaatttgtggatgccggcacattgtccgcagaggagcttgagctcagacatcatctgatcatatgtcaggtttacgaccaaatgacggcttctgaagtcaagctgacattgatggagaagctgcctgatgattatgaggtcgtcattgtgactgcagcaggcagccgtggcgaggagatcaggacagtgccattatttgagctggaccgcaatgtcgccttgaacaacttaacaagtgtgtatattccgccgattaaagaagagaagctgctttatcacgaattctccacgttccgaagcatcatcagagagcttcgcggacctaatggatgtccgtgggataaaaagcagacgcatcagtcattaaagcagtacatgattgaagaatgttatgagcttctcgaagctattgacgaagaagacacagaccatatgatcgaagagcttggcgacgttttgcttcaggtcttgcttcacgcgcaaattggtgaagatgaaggttatttcacaattgatgatgtcataaaaggaatcagtgaaaaaatggtccgaagacatccccatgtgtttaaagatgttaaggttcaggatgaaaacgatgttttggccaattgggaagatataaaaaaggccgaaaaaaatacatctgaatcatcgttactagacagcgtaccgaaaacccttccagctctttcgaaagctgctaaattgcagaaaaaagcagcgaaggtcggttttgactgggaagacgtcagcgatatttgggaaaaggtaagtgaggaaatgaaggaattttcttctgaggtttctgaagctcctcacgaacacaatcttaaagctgagtttggcgacattttgttcgcgctggtgaatgtagcccgcttctacaaaatagagccagaggaagcgctgaccatgactaatgacaaattccggagacggttctcgtacattgaggaaacagcgaaggaagagggagtcgagttggctgatatgtcccttgaggacatggacaaactgtggaatgaagcaaaagaaactgagaggagatcatagatatgagattagataaatttttgaaagtatcacggctgatcaaacggcgtacactagcgaaggaagtagctgaccaaggacgaatctctattaacggaaaccaagctaaagcaagctctgacgtaaaaccgggagatgaactaacggtccgcttcggccaaaagcttgtaacggttcaagttaatgaattgaaagacacgacgaaaaaagaagaagctgcaaacatgtacacgattctaaaagaagaaaaactcggcgaataggcttgttctaaaaaaattccctacctcatacaatgcagtaataatgctaaaagtatcgaggatatgggggctgaatagatgaattcatattatgatcaaaaaggttcttcgtctgttccggaacaacatgatgtgacaatgaaaggccggaagcatttagatatttctggggttaagcatgtggagagttttgataacgaagaattcctgctggaaacggtgatgggaatgctctccgtcagaggccaaaacctacagatgaaaaatcttgatgtggaaaaagggattgtttcgattaaaggcagggtatttgatttagtgtacttagacgaacaacaaggggataaagctaaagggttttttagcaagttgtttaaatgacgctgacgacacaattctatacaatgctggcgatgtccggtatgggtctctggcttggtgcttcgcttgatacataccggctctttgtcattcgtgccaaaacagccagatggctattatttattcatgatattcttttctggattgtgcaagggctgcttttcttttatgttttgcttcatgtaaatgagggagaattcaggatttacatctttttagcggttctgctgggcgttgcgacgtatcagagcctttgcaaacgaatctatataaaaatactgaaattcttcatttaccttgttgtttctgtttatcaattcttcaaaaaactcattcagcacgtgttatttcgtcctattgtgtggacatgcggagcgatcatctggctggcggcatttttattcaagaaaacatacagcctgataggttttctcctgctgtgtctatataaaatagtcatggttctgtgttttccgatccgttttatcgcgaaacaatgtttgaaacttcttcctgtgaaaatgcgtctaacttttagacgttattttgaaaaaggtgcaggatttctcaaaaagaagaagaaactattgataaccataagaacgaccattacacggtttttgaagaaatgaaaggaggaccgtctggtttgaatttttccagggaacgaacgataactgaaatacaaaacgactataaagaacaagtagaacggcaaaatcagctgaagaaacgaagacgcaaagggctgtacagacggttaactgtattcggcgccctagtattcctgacggcaattgtgctggcaagctctgtatggtcccaaacatcttcccttagtgcaaaagaagaaaagaaagaacagcttgaaaaagaactcaaaagtttaaagacaaaacaaacggatttaaaagaagaaatatccaaattgaaagatgaggattacgtcacagagcttgccagaagggacttattcatgtctggagacggagaaattatcttcaatgtggagaagaagagcaagtagccttgttgacacttaaatttttatttaggtataattaagcaaacgatctttttataagcctaaggaggagcactttttttatgtcgattgaagttggcagcaagttacaagggaaaattacaggtattacaaattttggagcatttgttgaattgcctggaggctcaaccggtctcgttcacattagtgaggtagctgataattatgtcaaagacattaacgaccacttaaaagtcggcgaccaagttgaagtgaaagtcatcaacgttgaaaaagacgggaaaattggtttatctattaaaaaagctaaagaccgtccgcaagccagacctagaaatgatttccgtccgaaagaatcttttgaacagaaaatgaataagtttttaaaagacagcgaagatcgcttgtcatctttaaaacgcaatacggaatcaaaacgtggagggcgcggagcaagaagaggataacttgctgctttctataaaataaatgaagcatccgttcatcccgacggatgcttttttattatcctcatcctctttaagagtcagaaaattacaacattaaagtttctgttgacgaaagagacaaacctttgtattatataacttgtgcttagaagcacaaaacaatatggcggtgtagctcagctggctagagcgtacggttcatacccgtgaggtcgggggttcgatcccctccgccgctaccatatttgtttggcccgttggtcaagcggttaagacaccgccctttcacggcggtaacacgggttcgaatcccgtacgggtcatcctaaaaaatcggtttctcttgcagaagccgatttttttcatttttagacaacattccggaaattcttttcataaacgaatatcaaggcagaaaccgtcgaagatttctttggtattgttaccttcttttgacaaaatcctatctgtgctttcgctataatgacaggcaacgaatataacaggtgggagatgagaggaatggaaaaagcagaaagaagagtgaacgggccaatggcgggacaagctttggaaaaactccaatcgttttttaacaggggcacgaagctggtgactcatcatttgcattcactgtttttctataaaggattcatttatgttgtcatcggatttttgcttggacgggctttcatattatccgaggtgcttcctttcgcacttcctttctttggagcgatgcttcttatcagaagagacaaagcgttttatgcggttttggctgtgcttgcaggtgcgctgaccatatctccaaagcactcattgctcatactggcggcattgctggcattcttcgtattttctaaagtggctgccttcattaccgacgatcgtgttaaagcgctcccgattgtcgtgttcttctcgatggctgcagcaagagccgggtttgtttatgcccaaaatggcgtatttacaacctatgattatgtaatggctatcgttgaagctggactatcgtttatcttaacactgattttccttcagagccttccgatttttactgtgaaaaaagtgaaacaatcattaaaaatagaggaaatcatttgctttatgattcttattgcctctgttttaacggggctggccggcttgtcctaccaagggatgcaggcagaacatatattggctcgttatgttgtattgagtttttcctttattggcggagcaagcatcggctgtacggttggtgttgtgaccggcctgattcttggcttggcgaatatcggaaacctatatcaaatgagtctgcttgctttttccggtttattgggcggtttgctgaaggaagggaaaaaagcgggtgcagcaattggtttgatcgttggatcacttcttatatctttatatggtgaaggctctgccggtctgatgacaacgctctatgagtcattaatcgcagtcggcctgtttttgctcacacctcaatctattacaaggaaagtggcgagatatattccgggaactgtcgagcatcttcaagagcaacagcaatacgctagaaaaatccgtgatgtcactgctcagaaggtagaccagttctccaatgtatttcacgcgctgtctgaaagctttgcaaccttttaccaagcgtcagacgaacagacagatgacagcgaagttgatctgttcttaagcaaaatcacggagcattcctgccagacgtgctacaagaaaaacaggtgctgggtacagaactttgataaaacatatgacttaatgaaacaagttatgcttgaaacagaggaaaaagaatatgcatcaaaccgaaggctgaaaaaagagtttcaacagtattgttctaaatccaagcaggttgaagagctgattgaggatgagctcgcacatcatcatgcccatttgacactcaagaaaaaagtccaagacagcaggcgccttgttgctgaacagcttttaggcgtttctgaggttatggccgacttttctcgggaaataaaaagagagcgagaacagcactttctgcaggaagagcaaatcatagaagcgcttcagcatttcggaattgagattcagcatgtcgagatctatagtcttgaacaaggaaatatcgatattgaaatgaccattccgttcagcggacatggagaaagtgaaaaaatcattgctcctatgctttctgacattctggaagaacaaattcttgtgaaagccgaacagcactctccgcatccgaatggatacagccatgtcgcctttggatcaacaaaatcatacagggtgtccacgggagctgctcacgctgcgaagggcggcggccttgtctccggtgacagctacagcatgatggagcttggagccagaaaatatgctgcagcaatcagtgacggaatgggcaatggtgcaagagcgcactttgaaagcaatgaaacgatcaagcttcttgaaaaaatccttgaatcgggcattgatgaaaaaatagcaattaaaacgatcaacagcatactgtctctaaggacaactgacgaaatatattccacgcttgacctatctattatcgatcttcaagatgccagttgtaaatttttgaaggttggatcgacgcctagctttatcaaacggggtgaccaggtcatgaaagttcaagcgagcaatctgccaatcggtattattaatgaattcgatgtggaggttgtgagtgaacagctgaaagcgggtgacctcttaattatgatgagtgatggcatttttgaggggcctaagcatgtggaaaatcacgacttatggatgaaacgtaaaatgaaagggttgaaaacaaatgacccgcaggagattgccgatttgcttatggaagaagtcatccgcacaagatccggccaaattgaggacgatatgactgttgttgtcgtccggattgatcacaatacaccgaagtgggcatccattcctgttccggcaatctttcaaaacaaacaagaaatttcataacgcttccgtataaatcaaatttcttctggcgaagatgggaatatatgaatctgagaatcctcgtattctccaggaggaatgaatgtgaacaacggacatttaaatcaaattttgctgataacggatggctgctcaaaccatggggaagacccgcttgcaatggctgcttttgctaaagagcaggggattacggtaaatgtcattggtataatggaagaaaatcaaattgaccctgaggcaatgaaggaagtcgaagggattgcacttgccggaggaggcgtgcaccaagtcgtttatgcatctcagctttcacaaactgttcaaatggtaacaaaaaaagcgatgacgcaaaccttacaaggtgtagtcaatcaagaactgaaacagattctcggaaagaatgtggaaatggaagagctttctccggaaaaacgcggcgaagtcatggaagtggtagacgagcttggagaaacggtgcatcttcaggttttggttcttgttgatacaagtgcaagtatggcgccaaagcttccaacagtaaaagaggcgctgattgatttgtctgtaagcctcaattcccgaatcgggaataacgaatttgcgatgtgtatatttcccgggaaaaaacaagaggtcgagcttgtgctgaactggacaccgaagctgcaatctctttccacactctttgcaaagctttcgacaggcggcatcacgccgacaggtccggcgattcgtgaagcgacactgcagtttgaaaaaatacgctcaagaaggggcatgctggcagatgatgaacgacgctttgacgagtttggcatgtagcctcaagccgggtacgacaatcaaaggcaagtggaatggaaacacttatacattgcgtaaacagcttggtaaaggggccaatggaattgtgtatttggcagaagcatcagatggacatgttgccttaaaggtgagtgatgacagcctgtctattacttctgaagtgaatgtcttgaaatctttctcaaaggcccagtccgttacgatggggccttctttttttgatacggatgatgcctatattcccagtgccaatacgaaagtttcattttatgcaatggaatacataaaagggccgctgcttttgaagtatgtcagtgataaaggagcagagtggatacctgtattaatgattcagctgttatccagcttatcggtgcttcaccagcaaggatggatattcggcgatcttaaacctgataatctgatcgtaactggtccgcccgcaaggatccgctgcattgatgtgggcggcacgacaaaggaaggccgggcgataaaagagtatacggagttttatgacagaggctattgggggtatggaacaagaaaggcagagccatcctatgatctgttcgcagttgccatgattatgatcaacagtgtgcataaaaaagaatttaagaaaacgaaccagcccaaagaacagcttaggtctctcatcgaaggaaacccgctgcttcaaaagtataaaaaagcacttttttcagccttgaacggagattatcaatccgcagatgaaatgaaaaaggatatgctagacgcggggcaaaaagcatcacaaagaaaacagcctataaaagcatcaccgcagcctgccacacgacaaagacagcaaataccgcgccaaggaaaaataacgaagacgcgatataccccaaaacagaaaccggctaagtcggggggttatttgaaacaacgcttatcgtgatcagtgttttagcgctttatttcgcctatattatctttttcttaatctgaatggcgcaaactgcagagcctatgcttcttctttgcttggaggggttgaaagtgttaggatatgaatatctttaaaatacctgctcattgtgaggaggacattgtgaaaagtgtcaaagattttttaaacaaacacaatcttacgttaaaaggggcgacaatcattgtaggcgtttccggcggtccggactcaatggctcttcttcacgcgttgcatacgttatgcggccgttcagcgaatgttattgcagctcacgttgaccatcggttcagaggtgcggaatccgaggaggacatgcgttttgtccaagcttattgtaaagctgaacagctcgtgtgcgaaacggctcaaatcaatgtaaccgcatatgcacaggaaaaaggactcaataagcaggctgcagcacgcgattgccgctaccagttttttgaggaaatcatgtcgaagcaccaagcggactatctggctcttgcgcatcatggtgatgaccaggttgaaacaatgcttatgaaactggctaagggtacgcttggaacgggacttgcgggaatgcagccggttagacgttttgggacggggcggatcatcaggccgttcttacccattacaaaggaagagatccttcactattgccgtgaaaacggcttgagctaccggacggatgaaagcaacgccaaagatgactacacaagaaacagattcagaaaaacagtgctcccgtttttgaagcaggaatctccggatgtgcataaaaggtttcagaaagtgagtgaagcactgacggaagatgagcaattcttacagtcattaacgaaagatgaaatgaataaagtaatcacaagccagtctaatacatcagttgaaatcaattcctctcaattgcttgccctcccgatgcctttacaaagaagaggagttcaactaatattaaactatctttatgaaaacgttccatcatccttttcggcccatcacattcagcagtttctcgattgggcggaaaatggcggtccttcaggagtactggactttccgaaagggctgaaggtggtcaaatcatatcagacatgtttgtttacatttgaacaatggcagtgcaaaaatgttccctttgaataccaaattagcggagcttctgatgaaacggcagtgctccctaatggatatctgatagaggcaaggcattatgcggactcgcctgaagaacatgggaatgctgtttttatcacaagtgaaaaaaaggtgcggtttcccttaacaatccggacgagaaaagctggagaccggatcaaactaaaagggatgaacggctcaaaaaaggtaaaggatatatttattgataagaaactgcctctccaagaaagagacaactggccgattgtgacggacgcaagcggtgaaattatctggatacctggcttgaaaaaatcaatttttgaagatcttgtgattccaaacagcgaccgcattgtattacaatatagacagcatgaaaagtgtagggggcaagcaaaatcatgatgaaacatgatatcgagaaagtactgatctcagaggaagagatacaaaagaaagtaaaagagttaggtgcagaattaacgagcgagtatcaagatacatttccgttggcaatcggtgtgttaaaaggagcacttccttttatggcggatcttatcaagcatattgatacatatttggaaatggatttcatggatgtatcaagctacggaaattctacggtttcttctggagaagtaaaaatcattaaagatttggatacatctgtagagggccgggacatcttaattattgaagatatcatcgacagtgggttaaccttaagttatctcgtagagctcttccgataccgtaaagcaaaatcaattaagattgttacccttttggataaaccgagcggaagaaaagcggacatcaaagcagactttgtcggttttgaagttcctgacgcgtttgtagtgggttacggacttgattatgctgagcgctatcgcaatctgccttatatcggagtgttaaaaccggcagtttatgaaagctgatcggcagcctgcttccgagatggttattgtttgtattggaatgattttctatggtactattgaacatagttgtgcttactgtgggaggaggtaaggaatgaatcgggtcttccgtaataccattttttatttacttattttattagtagtaatcggggttgtgagctacttccagacctcaaatccgaaaacagaaaatatgtcgtacagtacgttcatcaaaaacctggatgacgggaaagttgatagcgtatcggttcagcctgtcagaggtgtttatgaggtaaaagggcagctgaaaaactacgacaaagatcaatactttttgactcatgttcctgaaggaaagggagcagaccagatatttaacgctttgaaaaagacagacgtaaaggttgagcccgcgcaagaaacaagcggatgggtgacgttcctgacgaccatcatcccatttgtcattatctttattctgtttttcttcctgctcaatcaggctcaaggcggcggcagccgtgtcatgaactttggcaagagtaaagcgaagctgtatacagaggaaaagaaacgcgtcaaatttaaagacgttgcaggggctgacgaagaaaagcaagaacttgttgaagttgttgagtttctgaaagatccccgcaagtttgccgagctcggcgccagaataccgaaaggcgtgcttttagtcggacctccgggtaccggtaaaacattgcttgccaaggcttgtgcaggagaagccggcgtacctttcttcagcatcagcggatctgatttcgttgaaatgtttgtaggggtcggtgcttcccgtgtgcgtgacttgtttgaaaatgcgaaaaagaatgcgccttgtttgatcttcattgatgaaattgacgcagtcggacgccagcgtggcgctggtctcggcggtggacacgatgaacgtgaacagacgctaaaccaattgcttgttgaaatggacggattcagcgctaatgaaggaattatcatcattgctgcgacgaaccgtgcggacatcttggacccagccttacttcgtccgggacgttttgaccgtcaaattacagtggaccgtccagatgtcattggccgtgaagctgtattgaaagtccatgcgagaaacaaaccgctggatgaaacggttaacctaaaatcaattgccatgagaacaccaggcttctcgggcgctgacttagaaaacctcttgaatgaagctgcgcttgtagcggctcgtcaaaacaagaaaaaaatcgatgcgcgtgatattgacgaagcaacggaccgtgtaattgccggacctgctaagaagagccgcgttatctccaagaaagaacgcaatatcgtggcttatcacgaaggcggacacaccgttatcggtctcgttttagatgaggcagatatggttcataaagtaacgattgttcctcggggccaggctggcggttatgctgttatgctgccaagagaagaccgttatttccaaacaaagccggagctgcttgataaaattgtcggcctcttgggcggacgtgttgctgaagagattatcttcggtgaagtcagcacaggggcgcacaatgacttccagcgtgcgacgaatattgcaagacgaatggttactgaattcggtatgtcagaaaaactgggaccgttgcaatttggacagtctcagggcggtcaggtattcttaggccgtgatttcaacaatgaacagaactacagtgatcaaatcgcttatgaaattgatcaggaaattcagcgcatcatcaaagaatgttatgagcgtgcgaaacaaatcctgactgaaaatcgtgacaagcttgaattgattgcccaaacgcttctgaaagttgaaacgcttgacgctgaacaaatcaaacaccttatcgatcatggaacattacctgagcgtaatttctcagatgatgaaaagaacgatgatgtgaaagtaaacattctgacaaaaacagaagaaaagaaagacgatacgaaagagtaattcgctttctttctaaaaaaactgccggctgacgctggcagtttttttatgtaaatgatgtgctcaggtgcggcttttacaatcatccaattctggtatcgatttgtttacaaatgagccgctgatcgtgtatggtattgtagaatgtttgtaaaaagtaaagtagagaaactattcaaaagtggtgatagaggttgttactggttatcgatgtggggaacaccaatactgtacttggtgtatatcatgatggaaaattagaatatcactggcgtatagaaacaagcaggcataaaacagaagatgagtttgggatgattttgcgctccttatttgatcactccgggcttatgtttgaacagatagatggcattattatttcgtcagtagtgccgccaatcatgtttgcgttagaaagaatgtgcacaaaatactttcatatcgagccgcaaattgttggtccaggtatgaaaaccggtttaaatataaaatatgacaatccgaaagaagtgggggcagacagaatcgtaaatgctgtcgctgcgatacacttatacggcaatccattaattgttgtcgatttcggaaccgccacaacgtactgctatattgatgaaaacaaacaatacatgggcggggcgattgcccctgggattacgatttcgacagaggcgctttactcgcgtgcagcaaagcttccgcgtatcgaaatcacccggcccgacaatattatcggaaaaaacactgttagcgcgatgcaatctgggattttatttggctatgtcggccaagtggaaggaatcgttaagcgaatgaaatggcaggcaaaacaggaaccaaaggtcattgcgacaggaggcctggcgccgcttattgcgaacgaatcagattgtatagacatcgttgatccattcttaaccctgaaagggctggaattgatttatgaaagaaaccgcgtgggaagtgtataggaggtttagtaatggattatttagtaaaagcacttgcgtatgacggaaaagttcgggcttatgcagcgagaacgactgatatggtaaatgaggggcagagacgccatggtacgtggccgacagcatccgctgcattgggccgcacaatgacagcttcacttatgctcggcgctatgctgaagggcgatgataagctgactgtgaaaatcgagggcggaggtccgatcggagctattgtagctgatgccaatgccaaaggagaagtcagagcctatgtctctaacccgcaagttcattttgatttaaatgaacaaggcaagcttgatgtcagacgtgcggttggaacaaacggaacgttaagtgtcgtaaaagatttaggtttgcgcgagttcttcacaggacaagtagaaatcgtttcaggagaattaggcgatgatttcacttactatcttgtatcatctgagcaggttccttcatcagtgggcgtaggtgtgctcgtaaatcctgacaataccattcttgcggcagggggctttattattcagctgatgccgggaacagatgatgaaacaatcacaaaaattgaacagcgtctatctcaagtagagccgatttctaagctcatccaaaaagggctgacaccagaagaaattttagaagaagtcctaggcgagaaacctgagattttggaaacgatgcctgtcagattccattgcccttgttcaaaagaacggttcgaaacagccattttaggactaggcaaaaaagaaattcaagatatgatagaagaagatggacaagccgaagcagtatgccatttttgtaatgaaaagtacttatttacaaaagaagagctggaagggcttcgtgaccaaactacccgctaagctctttagcgggtttttaatttgagaaaaggggctgaaagcaggtttgaaatcaagaacaatctggaccattattttaggggcgctgttggtttgctgtattgctgttgcatatacgctgacgaaatcccaagccggcgcatcgtcatccggtgagtctattgcgactatcgggggcaagagtgtgacaagagaagaatggctgaaagaaatggaagatcagtatggtaagtcaacgcttgaagatatgatcaatgtccgagttgttgagcagctggctaaaaagaacaaccttaaaatatccaaaagcgaagttgatcgtgagtttttgctgattaaagcggtcaataattccttttacgaagatgaacatacgacggagaaagagtggaaagaccaaattcgttataatatcctccttgaggaattgttaacaagggatatcgatatctcaaacaaagaattggaatcattctataataaaaataaggaactatatcagtttgatgattcgtatcgaattcggcacattgttgtaaaagatgaagaagaagcgagagaagtcctaaaagaactgaaaggcggatcaagctttgaagctgtcgctgccgaaagatctacagacagatatacatcaccatacggcggagatttaggttttgtcacagaggcatcagacaacattccatcagcatacattgaagaggcgaaaacactcaaagaggatgaatggtctcaggaaccaataaaggtcagcaacggatatgccattatccagctgaaagaaaaactaaaggcaagaacgttctcatttgatgaagtaaaggaccagatcagacggcaaattgcaatggatcagctaggcgataaagcgacagttaagacactttggaaagaagccgatgtatcttggttttatggggaaaaaagtactaagtgattgacaaaaaattttgaaattgatagattatatacataataccaatacaaatagtcggaaattgaggtgtcgagaatggtacgtgtagcaaactccattactgaattaattgggaatacgccaatcgttaaattaaatcgccttgcagatgaaaacagtgcggatgtatatctaaaacttgaatacatgaaccctggaagcagtgtaaaagaccgtatcggtttagccatgattgaagcggctgaaaaagaaggaaaattaaaagccggtgatacaatcattgaaccgacaagcggaaatactggaatcgggcttgcaatggttgctgctgctaaaggattaaaagccattttggttatgcctgatacaatgagcatggagcgccgcaaccttcttcgcgcatacggtgctgaacttgtgctgactcctggtgcggaaggcatgaaaggtgccattaagaaagctgaagagcttgctgaaaagcacggatactttgtgccgcagcagtttaacaacccttctaacccagaaattcaccgccaaacaactggtaaagaaatcgttgagcaattcggtgatgaccagcttgatgcatttgtagccggaatcggaacgggcggaacgattacgggagcgggtgaagtgctgaaggaagcatacccttccatcaagatttacgctgttgaaccgtcagattccccagtgctttcaggaggaaaaccaggcccccacaaaattcagggaatcggagctggattcgtgccggacatcttaaacactgaagtatatgatgaaatcttccctgtgaagaatgaagaagcattcgaatatgcccgcagagctgcacgtgaagaaggaattctcggaggcatctcatcaggtgcggcaatttatgctgctcttcaagtagcaaaaaaactcggaaaaggcaaaaaagtattggccatcattccaagtaacggcgaacgttatttaagcacgccgctgtatcaattcgattaaaaaaagccaaaactcccggtccgccgggagtttttttatatttcgtgcatcaaatatgccatgtctgcgacgaatgttattcttggaagagaaattcacttttttcactaacaacattgctttacaattaaaaacaagtaaaaaagaaaatagaggaatgatacaaatggcacaacgcagaccggcaggcaaaaaagtaccttttcaaaaagactcattcttacaacaatttgagaaacttgcgcaatcccggaaacatcatgtacttctcgaaagtgcaagaggcggcagatatagtatagccggtcttgatccaattgcgactgtgaaaggaaaagacggaataactacaattaagcatggtgatgagatgctgtttaaagaaggtgatccattacgggccttccacagctggtttaaaacgctggaaacagaaacgaatcatgagttccctgactttcaaggcggggcaatcgggtttctcagctatgattacgcacggtacattgaaaattttaaaatgctctcattagatgatctagaaacaccagatatttattttcttgtttttgatgatatagcagtttatgaccatcaagaagagtctctatggctgattactcatgttaatggttctgatcatgaaacagcggatgtgaagctatctgagttagagcagatgtggctgactgagcttcccgctgtctcttcgcgagagatgaaccctgaaacagatggttctttcgcggcgccatttaccgaggatgggttctcacaagctgtagagaaaatcaaacaatacattgccagcggagatgtgtttcaagtcaatctatcaataaggcagtcacagtcactgtctgtccacccatatcaaatttacaaaaccttgagagaagtaaatccttctccttatatggcgtatttagaaacacctgattttcagatcatttgcggatcgcctgaactgcttgtcagcaaaaagggcaagctattagagacgagaccgattgcgggcacccgttccagagggaaaacaaatgaagaagacgaggcgcttgcaaacgaattgatacacaatgaaaaagaacgcgcagaacatgtcatgctggttgatcttgagcgaaatgatctgggaagagtatcacgttacgggtctgtgcgcgtaaatgaattcatggcaattgaaaaatactcgcatgtgatgcacattgtgtctaatgtccaaggtgaactgcaggatgggtatgacgctgtagatattattcatgctgtgtttcccggaggaaccattactggtgcaccgaaagtaagaacgatggaaattatagaagaacttgagccgacacgccgagggctttatactggatctatagggtggtttggatataatcacgatctgcagtttaatatcgtcattcgaaccatttatgcaaccggagggcaggcatttatgcagtccggcgcaggagttgtgattgattctgttccgaagcacgaatacaaggaatcattcaaaaaagcttttgcgatgcaaagagcattagagctgagcaaagaagagacaaaaattagatgaggtgagcggagaaatgattttaatgattgataactacgattcattcacgtacaacttggtacagtatttgggcgagcttggggaagagctggttgtgaaacgcaatgacagcatcacaatcgaagaaattgaagaactgtctccggactttctgatgatatctcccggaccgtgcagccctgatgaggcgggaatcagtctcgaagcaattaaacatttcgcagggaaaattcctattttcggtgtatgtctcggacatcagtccatcgcacaagtgttcggcggtgatgttgttagggcagaacggcttatgcacgggaaaacctcggatatcgagcatgacggcaagaccatttttgaagggttgaaaaaccccttgttgcgacgcgataccactcgctgatcgtaaaacctgagacgctgccaagctgttttacagtaacagcacaaacgaaagaaggagaaatcatggctattcgccacaatgacctcccgatagagggcgtgcaatttcacccagagtctattatgacctcctttgggaaagaaatgctcagaaattttattgagacatatcgcaaggaagttattgcgtgatgatatatgtgaacggccggtatatggaggagaaagatgcagttctttctccttttgaccatgggtttttatatgggatcggtgttttcgaaaccttcaggctctacgaaggctgtccgtttttgcttgattggcatatagaaaggcttgaacgagcgcttaaggacctgcaaatcgaatatactgtttcaaagcatgagatccttgagatgctggacaagctgcttaagctaaataatatcaaggatggcaatgcccgcgtcagactgaacatatcagcggggatcagcgataaaggctttgtcgcccagacgtacgataagccgaccattttatgctttgtgaatcagctgaaaccagaaagccttcctttgcaaaaagaagggaaggttttatcgatacggagaaacactcctgagggatcgttccggttaaaatctcatcattatctaaataatatgtatgcgaaacgggaaattggaaatgatccgcgtgtcgagggaattttcctaacggaggatggagctgttgcagagggtatcatatctaatgtcttttggagaaaaggtcgttgtatctatacgccatcgcttgataccggtattctggacggcgtcacgagacgttttatcatagaaaatgcaaagaatatcggcctggagctcaaaacgggccgatatgagctagaagctctcttgacagctgacgaagcgtggatgacgaactcggttcttgaaatcatcccgtttactaaaatagaagaagtaaactatggaagccaaagcggagaagcaacctccgctcttcaattgttatacaaaaaagaaataaagaacatgattcatgaaaagggaggaagagcatggcgcagcacacaatagatcaaacacaagtaatccacactaagccccgcgctttatcatataaagagaagacgctggtgatgggaattttaaacgtaacgcctgactctttctcggacggcggaaaatatgacagcttggacaaggcgctgctgcacgcgaaagagatgatcgatgatggtgcccatatcattgatatcggaggggaatcgacaaggcctggcgctgagtgcgtatctgaggatgaggagatgtccagagtcattccggtgattgagcggattacgaaagagcttggtgttcctatttctgtagacacgtacaaggcttctgtcgcagatgaagcagtgaaagccggtgcatccattatcaatgatatttggggagccaaacatgatccgaagatggcttccgttgcagctgatcataatgttccaattgttctcatgcataaccgccctgaaagaaactacaatgacttattgccggatatgctgtcggacttaatggagagtgtaaaaattgctgttgaggccggagtagacgagaagaacattattcttgatcccggtatcggtttcgcgaaaacctatcacgataacttggcagtgatgaacaaactagagattttcagcggattgggatatccggttcttctggcaacctcccgaaaaagattcatcggacgtgttctggatcttccgcctgaggagcgggctgagggcacaggcgcgactgtgtgtctcggcattcaaaaaggctgtgacattgtcagggtccatgatgtaaagcaaattgccagaatggcgaaaatgatggacgcgatgctgaataagggaggggtgcaccatggataaagtttatgtagaaggtatggagttttacggatatcacggtgtgttcaaagaagaaaacaaacttggccagcggtttaaagtcgatttaaccgctgagctggatttaagcaaagccggacaaacagacgaccttgagcaaacgatcaactatgctgagctctatcacgtatgtaaagatatcgtggaaggggagcctgtaaaattggtagaaacgctggcggaacgtattgctggcactgttctcgaaaaatttcagcctgttcagcaatgtacggtgaaagtgattaagccagacccgccaattcccggacactataaatcagtagcaattgaaattacgagaaaaaagtcatgaacaacatagcttatattgcacttggatctaatattggagatagagaaacgtatttaaggcaagcagtggctttactgcatcagcatgctgcggtgacagtcactaaagtgtcgtctatttacgaaactgacccggtcggatacgaagatcaagctcaatttttgaatatggctgttgaaatcaagacatcactgaacccttttgaactacttgaactgacgcagcagatagaaaatgaattaggcagaacaagggaagtaagatgggggccgcggacggcagaccttgacattttgttatttaatcgtgaaaatattgaaacagagcaactaattgttccgcatccgagaatgtatgagcgtttgtttgtccttgcgccgcttgcggaaatttgccagcaggttgaagaagaggctacaagcgccgaaacagaccaagaaggtgtaagagtatggaagcagaaatctggggtagacgaattcgtgcattcagaaagctgaaaggttatactcaagaaggttttgcaaaagcattaggtatatcagtttctattctcggcgaaattgaacgcggaaaccgattgccgtcagctgccatcattcaagatgcagctgatgttttaaatataagtgcggacgaattggcgccgccagaaaaatagaacaaatgaaaggaggagaaaaattgttcaaaatcggagatattcaattgaaaaaccgggttgtgctcgcacctatggctggtgtctgcaactctgcgttcagattgactgtaaaggaattcggagccggattggtatgcgctgaaatggtcagtgacaaagcgatcctttacaacaatgcaagaacaatgggtatgctttatattgatgaacgtgagaaaccactgagccttcaaattttcggaggaaaaaaggaaacccttgtggaagcggcgaagtttgtagaccaaaacacaactgctgatatcattgatattaacatgggatgtcccgtgccgaagattacaaaatgcgatgcgggagccaaatggcttctcgaccctgataagatttacgaaatggtttctgcagtagtggatgctgttaataaaccagttacagtgaaaatgagaatgggctgggatgaagaccacattttcgcagtgaaaaatgcacaggctgtagaacgtgcgggcggtaaagcagtggcgcttcacggccgtacgagagtgcagatgtacgaaggaacggcaaactgggatatcatcaaagaagtaaaacaatcagtttcgattccggttatcggaaacggcgatgttaagacaccgcaggatgctaagcgtatgctcgatgagacaggagtagacggggtcatgatcggacgcgctgcattgggcaacccgtggatgatttaccgtacggttcagtatcttgaaacaggtgaattaaaagaagagccgcaagtacgcgaaaaaatggccgtatgcaaactgcatcttgaccgcctgattgacttaaaaggtgaaaacgtagcggtaagagaaatgagaaagcatgctgcatggtatctgaaaggcgtgaaaggcaatgcgaacgttcgtaatgaaatcaatcattgcgagacgagagaagagtttgtacagcttttagatgcatttacggttgaagttgaggcaaaagagcttcaaaatgcaaaagtaggataatactcacctctatttgctgctcactgctagttttacgctggcagtttttctgcttttttcatgaaacaatatctgtaatggagtgataacaatgagtcaagaagagcataaccatgaagaattgaatgatcagctgcaagtcagacgcgataaaatgaatcagctgagagataacggcatcgatccattcggcgcacgttttgaaagaactcatcagtctcaagaagttatttcggcatatcaagatctaaccaaagaagagttagaagaaaaagcgattgaagttacaatcgcaggccgcatgatgacaaaacgcggcaaaggaaaagccggctttgcccatcttcaggatttagaaggccaaatccaaatctacgtaagaaaagacagtgtcggtgacgaccaatatgaaatcttcaagtcttctgacctcggtgatcttatcggcgtaaccggaaaagtcttcaaaacaaatgtaggcgaattgtctgttaaagcaacttcctttgaattgctgacaaaagcgcttcgtccgcttcctgacaaataccatggtttaaaagacgttgagcagcgctaccgtcagcgctacctggatcttatcgtaaacccagacagcaaacatacgttcattacacgaagcaagatcattcaagctatgagaagataccttgatgatcatggatacttagaagtagaaacacctacaatgcacagcattcctgggggagcttctgcgcgtccgtttatcactcaccacaacgcgttagacattccactctatatgcgtattgctatcgaactgcacctaaaacgtctaattgttggcggtttagaaaaagtatatgaaatcggccgtgttttccgtaacgaaggtgtctctacacgccataaccctgaatttacaatgattgagttatatgaagcatatgcggactataaagatatcatgagcttaactgaaaaccttgtcgctcatatcgcccaagaagtgcttggcacaactacgattcaatacggggaagagcaaatcgaccttaaaccggagtggaaaagaatccatatggttgacgcagtcaaagaagcgaccggcgttgatttctgggaagaggttactgttgaacaggcgcgtgaatatgcaaaagaacatggtgtagaaattaaagattctatgacagtaggccatatcatcaacgaattcttcgagcaaaaaattgaagaaacgcttattcagccaacgtttatttacgggcatcctgtagaaatttctcctcttgctaagaaaaaccctgaggacccgcgttttacagaccgttttgagctgtttatcgttggccgtgaacatgccaacgcgtttacagagctgaatgatcctattgatcaaagagaacgctttgaagcgcaattaaaagagcgtgaagccggtaatgatgaagctcatttaatggatgaagactttgttgaagctctggaatacggtatgccgccaacaggaggtttaggcatcggtatcgaccgtctggttatgttgctgacgaatgcccttctattcgcgatgtgctgttattcccgcaaatgagacaacgctaataaggaagagcggtatcctccatagggaaaggatgccgctctttttaaattccttagtatttcttcaaaaaaactattgcactattatttactaggtggtatattattattcgttgccgctaaacaaggcgataacgaaaaaaagaaattcaaaaaaagttattgacttcactgagtaaacgagttataataataaagtcgcttgaacgaagtgaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttaggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtcccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattttacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccgggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatgggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctacccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacatctgttatctagttttgagagaacactctcaatttgtttggtggcgatagcgaagaggtcacacccgttcccataccgaacacggaagttaagctcttcagcgccgatggtagtcgggggtttcccctgtgagagtaggacgccgccaagcaattgcacgttagtgcaattatggaggattagctcagctgggagagcatctgccttacaagcagagggtcggcggttcgagcccgtcatcctccaccattatgccggtgtagctcaattggtagagcaactgacttgtaatcagtaggttgggggttcaagtcctcttgccggcaccacttttatatgatataatactcaagtctcttgtagaagagccattagctcagttggtagagcatctgacttttaatcagagggtcgaaggttcgagtccttcatggctcaccattttacgcgggtgtggcggaattggcagacgcgctagacttaggatctagtgtctttatgacgtgggggttcaagtcccttcacccgcattatataggataacagttagaaaaactggacatcctgtctgcggaagtagttcagtggtagaacaccaccttgccaaggtggggtcgcgggttcgaatcccgtcttccgctccaactataccatccacgccggggtggtggaattggcagacacacaggacttaaaatcctgcggtaggtgactaccgtgccggttcaagtccggccctcggcattatgttttgcgcccgtagctcaattggatagagcgtttgactacggatcaaaaggttaggggttcgactcctctcgggcgcgccatatcttttaatagaatagatgggaaatcgggaagtagctcagcttggtagagcacatggtttgggaccatggggtcgcaggttcgaatcctgtcttcccgaccattttttatggggccttagctcagctgggagagcgcctgctttgcacgcaggaggtcagcggttcgatcccgctaggctccaccaaaagtttttaaaaaagttgttgactttgaagaagtgacgttgtatactaataaagttgctttaacaaagcggacaaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccgggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgcccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtcccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattttacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccgggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacatctgttatctagttttgagagaacactctcaatttgtttggtggcgatagcgaagaggtcacacccgttcccataccgaacacggaagttaagctcttcagcgccgatggtagtcggggtttccccctgtgagagtaggacgccgccaagcaagcttaaacccagctcattgagctgggttttttgtattttggtttattggtatcataaaattccacttaactgtataatataataactttataccgaattttaaatcagcaatcaggttttgtggaccgggaaaatggaaataataaaggatagagcgagaaagttgaaaattctcgagaaacggcttatagtaagattatagtcaaatatagtcaaagtcagtaaaggagggggttgagtgggacataatatttctgacatcattgaacaatatttaaaacgagtgttagatcaaaatggcaaggaaattttagagattaaacgaagtgaaattgcagataaatttcaatgcgttccttcccaaataaattatgtcatcaacaccagatttacaagcgaaagaggatatattgttgagagcaaacgcgggggcggcggttacatcagaatcattaaaattaaaatgaacaatgaagttgtcctgatcaataatattatttctcaaattaatacccatttgtctcaagcagcctctgatgacattattttaaggctattagaagacaaggtaatttcagaaagagaagcaaaaatgatggtcagcgtaatggaccgctcagttttacacattgacttacctgaacgtgatgaattaagagcgagaatgatgaaggcaatgctgacttctttaaaattaaaataagcaggtgaaaagattgatttgtcaagagtgccacgagagaccagccacttttcactttacaaaggttgttaacggagaaaaaatagaagttcatatttgtgaacaatgtgccaaagaaaatagtgattcatatggtataagtgcaaatcagggtttctctattcataatttactttcgggtttactgaacatggattcttcatttcaaaatgcaggaactcaaatgttcagtcactcggagcaaatatctgcttgtccgaaatgcggaatgacttttcagcaattcagaaaaattggccgttttggatgttctgaatgttacaaaacatttcatagcaacattacaccaatcctacgtaaagtgcacagcggaaacactgtgcatgcaggtaagataccgaaacgaataggcggcaatcttcatgtcagacggcagattgatatgctaaaaaaggaattagaatccttaatccatcaagaagaatttgaaaatgcagctcatgtaagagatcaaattcgttcattagaacaatcactcaaaagtacagatagtgaggaggaacaggagtaatgtcgctaaagcattttattcaggacgcactaagcagttggatgaagcagaaaggacctgaaagtgacattgtactcagcagccgcatacgtttagcaaggaactttgagcatattcggttccctacgcggtattccaatgaagaagcctcatccatcatacagcaatttgaagatcagttttcagagcaggaaattcctggaatcggcaaatttgttttgattagaatgaatgatgcacagcctttagagaagcgtgtacttgttgaaaaacatctaatcagtccgaatctgacagagtctccttttggcggctgtttgctttctgaaaatgaggaagtaagcgtcatgctaaatgaagaggaccatattagaattcagtgtcttttccctggatttcagcttttagaagcaatgaaagccgcaaaccaggtcgacgactggattgaagaaaaagttgattatgcattcaatgagcaaagaggatacttaaccagctgtcctacaaacgtaggtacaggtttaagggcttcggtcatgatgcatctgccggcactagttttaactaggcaaataaatcgaattataccggcaattaatcaattaggcttagttgttagaggaatttatgggaaggcagcgaagcagtagggaatatctttcaaatttcaaatcagatcacgcttggtaagtcagagcaggatattgtagaggatcttaacagtgttgctgctcagttgattgaacaagaacgatctgcccgagaagcgatttatcaaacttctaaaatcgaacttgaggatcgggtatatcggtcttatggggtcttgtctaattgccggatgatagaatcgaaagaaactgcaaagtgcctttcagatgttcggttaggcatagacctaggcattataaaaggactttcaagcaacatacttaacgaacttatgattttgacgcagccaggatttttacagcaatactcgggaggcgctttgcgtccgaacgaaagggacattcgaagagcggctctcatcagagaacggcttcacttagaaatgaatgggaaaagacaggaggatgaatcgatatgatgtttggaagatttacagaacgagctcaaaaagtactggcgctagcacaggaagaagcacttcggttaggtcataataacattggcactgagcatattttattaggactggtaagagaaggagagggcattgctgctaaagctcttcaagcgcttggactcggttcagataaaattcagaaagaagtagaaagtttgatcgggcgcgggcaggaaatgtctcaaacgattcattatactcctagagctaaaaaagtcattgagctttcaatggatgaggcaagaaaactcggtcattcttatgttggaacagaacatattcttcttggtctgattcgtgaaggagaaggtgttgctgcgagagttctgaataatctcggtgtcagcttaaataaagcaagacagcaggtgctccagcttctaggaagtaatgaaacaggatcatcagcggcaggaacaaacagcaatgcgaatacgcctacgcttgacagcttggcaagagacttaactgctattgcgaaggaagacagccttgaccctgtaatcggcagaagcaaggagatccagcgtgtcattgaagtgttaagccgcagaacgaaaaacaaccctgttctcattggggaaccaggtgtaggtaaaacggctatcgcagaaggattggcacagcaaattatcaataatgaagtacccgaaattttgcgtgataaacgtgtgatgacattagacatgggaacagttgttgccggcacaaaataccgcggagaatttgaggatcgcctgaagaaggtcatggatgaaattcgccaggcaggaaatatcattctattcatcgatgagctccatacattaatcggggcaggcggagcagaaggtgctattgatgcatctaatattttaaaaccttcacttgctcgcggcgaactccaatgtattggtgcaacgactcttgatgagtaccgtaaatatattgaaaaagatgcagcactggaacgccgttttcagccgattcaggttgatcagccatctgtagatgaaagtattcaaattttacaaggtctgcgtgacagatacgaagcccaccaccgcgtttctatcactgatgatgccattgaagctgcggttaagctttctgacagatatatttctgaccgcttccttccggataaagcaattgacttgatcgatgaagcaggttcaaaggtgagactgcgctcatttacaacgcctcctaacttaaaagagcttgagcagaagcttgatgaggttcgcaaagagaaggatgcggcagtgcaaagccaagagtttgaaaaagctgcttccttgcgtgatactgaacaacgcctgcgcgagcaagtagaggatacgaagaaatcatggaaagagaagcaagggcaggaaaactcagaggttactgtggatgatattgcgatggttgtatccagctggaccggtgtgcctgtatctaaaatcgcccaaactgaaactgataagcttctcaatatggaaaacattcttcattcccgcgtcatcggccaggatgaagcggttgtagctgttgcaaaagccgtcagacgtgcgagagcaggattgaaagatcctaaacgcccaatcggctcattcattttcttaggccctacaggtgtaggtaaaacagagcttgcacgagcacttgctgaatccatttttggcgatgaagaatccatgatcagaattgatatgtctgaatacatggaaaaacactcaacttcaagacttgttggttcacctccgggtatgtgggatatgatgaaggcggtcaattgacagagaaagtcagaagaaaaccttactctgtcgtgcttcttgatgagatcgagaaagcacaccctgatgtcttcaatatccttctgcaagttcttgaagacggacgattgactgattctaaaggacgcacagtcgatttccgcaataccattctgatcatgacatcaaacgtcggagcaagtgagctgaaacgcaataaatatgtcggctttaacgttcaggatgaaactcaaaatcataaagacatgaaagacaaagtgatgggtgaattaaaacgagcgttcagacctgagttcatcaaccgtatcgatgaaatcattgtcttccattcactggagaaaaaacatcttactgaaattgtgtcattaatgtctgatcaattaacgaaacgcttgaaagaacaagatctttctatcgaattgacagatgctgcaaaagcgaaagtcgcggaagagggcgttgacctggaatacggtgcccgtccgttaagaagagcgatccaaaaacatgtcgaggatcgtttatctgaagaactcctcagaggaaatattcataaaggacagcatattgttcttgatgtagaagatggcgaatttgtcgtaaaaacgactgctaaaacgaattaatatagaagacggaaatgaggcatacagcatgtaagtgtatgcctcactttcatatcaagaaatagaacaagggagaggtcttacactatatatggctaaaacaaaatcgaaattcatctgccaatcctgcggctacgagtctccaaaatggatggggaaatgtccgggctgcggtgcttggaatacaatggtggaagaaatgattaaaaaagcaccggccaatcggagagcggctttttctcattctgttcaaactgtacagaaaccttcacctattacatcaatcgaaacatcagaagaaccccgcgtcaaaacccagcttggcgagtttaacagagtactcggcggaggtgtagttaaaggctccctcgttttaattggcggtgatcctggtatcggaaagtcaacgctattactgcaggtttccgctcaattatcaggctcatcaaacagtgtcctgtatatttcgggagaagaatctgtaaagcaaacgaagctgcgagcagaccgtcttggcattaataatccgtcactacatgttttatctgaaaccgatatggagtatatttcgtctgctatacaagagatgaatccagcgtttgtcgttgttgactctattcaaacggtttaccaaagcgatattacatcggctccaggcagtgtgtcacaggtcagagaatgtactgctgagctgatgaaaatcgcaaaaacaaaaggtattccgatttttatcgtagggcacgtgacgaaagaagggtctattgcaggtccgagactgttggagcatatggttgacactgttttatattttgaaggagaacgccaccatactttccgtattttgcgggctgtaaaaaaccgtttcggatctacaaacgaaatgggcattttcgaaatgcgggaagaggggctcactgaggttttgaatccttcggaaattttcttagaagaacgctctgctggttccgcaggttcgagtatcactgcttctatggagggcactagaccgattctcgttgaaattcaggcgctcatctcgccaacaagctttggcaacccaaggcgtatggcaacgggaatagaccataacagggtttctctgttaatggctgtgttagaaaaaagagttggactactgctgcaaaatcaggatgcttatttgaaagtggctggcggcgttaagcttgatgaaccggcaattgatcttgcgattgtgattagtatcgcatcaagctttagagacacacctccaaatcctgcagattgttttattggagaagtgggattaaccggagaagtccggcgggtttcaagaattgaacagcgtgtgaaagaagcggcaaagcttggctttaaacgcatgatcatacccgcggcaaatctggacggatggacaaaaccaaaagggattgaggttatcggagtagcaaatgttgcagaagcgcttcgtacttcattaggaggataatagatggaaaaagagaaaaaaggggcgaaacacgagttagacctgtcatctatattgcagtttgttgctccgggtacaccgctcagagcggggatggaaaacgtcttgagagcaaatacaggcggtctgattgttgttggatataatgataaagtaaaagaagtggtggacggcggctttcacataaacacggctttttctccggcgcatttatatgagttggctaaaatggatggagcgatcattttaagtgattcgggtcaaaagatcctctacgcgaatactcagctgatgccggatgccacaatttcttcatcagaaacaggaatgcggcacagaactgccgaaagagtagctaagcaaactggctgtcttgtaatcgctatttctgaaagaagaaatgtcataacgttatatcaggaaaacatgaagtatacactaaaagacataggatttattttaaccaaggcgaaccaagccattcaaacacttgaaaaatataagacaatcctcgataaaacgattaatgcactgaacgcgttagagtttgaggaacttgttaccttcagtgatgtcttgtctgtcatgcatcgttatgaaatggtactgagaatcaaaaacgaaattaatatgtatatcaaagagctggggacagaagggcatctgatcaaactgcaagtcattgaattgattacggatatggaagaagaggccgctttatttattaaggactatgtaaaagaaaagattaaagatccgtttgttctcttgaaggagctgcaggatatgtccagttatgatctgctggatgattccattgtgtataagcttctcggttaccctgcttctactaatcttgatgattatgtattgccgagaggatacaggctgttaaataagataccgcgtcttccgatgccgattgttgaaaatgttgtagaagcatttggagtcctgccaaggattattgaggcgagtgcagaagaattagatgaagtagagggaatcggtgaagtacgagcccaaaaaatcaaaaaaggattaaaacgcctgcaagagaagcattatttagacagacaactgtgatttcggttaaaaccttatgaatacgggtatattaatgttggtttttgtttattctgatattcgtaggatgcataagactttgtgaaattaaaatgttaaaaaaggaggtgggggtatgttaaaacgaatagttcaggcgttcttcattatttttggcggcgttgttggtatatttttgatacctgaattgtttgtactgttaaatatacaggacatacctttaataacaaacgcatatacgtctgcggcaataggagcaattatcttttttctcatcagtatatggggtacagaatacgttgtgaactgggtgaagtggatagaggattcattgttaaaagcgccggttccagatttgttatttggaagtcttggcttagtttttggacttataattgcttatcttatcgtaaatgttattcctttagacaatataccttaccgcatattcagcacaataattcctgtatttttggctttcttcctcggttatctcggcttccaggtgggctttaagaaaaaggatgaattgatcagcctgttttccatttccgccagaatgcaaaagaaaaaaggaacagctgatgaagaacatgaggttcaagacaagaagctgaaaattttggacactagtgttattattgatgggagaatagcagatatttgtcagactggttttttagagggagttatcgtgattccgcagtttgtccttgaggaattgcagcatattgcagactcttcagatgttttaaaacgaaacagaggacgccgcggtcttgatatcctgaaccgcattcagaaagaattagacattgaagttgaaatttacgaaggcgactttgaagatattcaggaggttgacagcaagctcgtcaaacttgctaagctgacatccggggtcgttgtgacgaatgattttaatttaaataaagtatgcgagcttcagaaggtagcagtattaaacattaatgaccttgccaatgcggtcaagcctgttgtgcttcctggcgaggaaatgaatgttcaggtcattaaggacgggaaagagcataatcagggagttgcctacttggatgacggtacgatgattgtcgttgaagaaggacgaaattatatcggcaagcatattgatgtactcgtcacaagtgtgctgcagacagcagcgggacgaatgatttttgcgaagcctaagctgttggagaaggcgctgtaaagggagaagaaacaatgagttatgatgtggtgattcctgcagccggacagggaaagcggatgaaggcagggagaaataaactgttcattgatctgaagggagacccggtgatcatacacacgttaagagtgtttgacagccaccggcagtgcgataaaatcattttggtgattaacgagcaggagcgggagcactttcagcaattgctgtccgattacccgtttcaaacttcaattgagcttgttgcaggcggagaagagcgtcagcacagtgtgtataaggggctgaaagccgtaaagcaggaaaagattgtccttgtacatgacggtgcccgcccatttataaaacatgaacaaattgacgaactgatcgcagaggcggaacagacaggagcggccatccttgctgttccggtaaaagatacgattaaacgcgttcaagatttacaagtcagtgagacgattgaacgttcaagcttgtgggctgtccaaacgccacaagcttttcgtctttctttattgatgaaggctcacgctgaggccgagcgcaagggatttttagggacggatgacgccagcctcgttgaacagatggagggcggttcggtccgtgttgtagaaggcagctatacaaatattaagctgacgacgccagacgatttgacgtcagctgaagctatcatggaatcagaaagtgggaataaacatgtttagaattggacaaggatttgatgtgcatcaattagtggagggccgtcctctcattattggcggaattgaaatcccgtacgaaaaagggctgcttggccattctgatgcagacgtattgctgcatactgtcgctgacgcctgcctgggagctgtgggtgaaggagacatcggcaagcattttcctgacacagatcccgagttcaaggacgcagattctttcaaattacttcagcatgtctggggaatcgtgaaacagaaggggtatgtccttgggaacattgattgcaccatcatagcgcaaaagccgaagatgctgccgtacatagaagatatgagaaaaagaattgctgaaggccttgaggcagatgtttctcaagtaaatgtaaaagcaacaacgacagaaaagcttggatttacaggccgggcggaaggaatagcggctcaggcgacagtactgatacaaaaaggctaacttgttttgatgccgggtctatttggtggtagaatagattcatacatttttgcctgaggccatacatgacatgaaaggaagtatttgaaaatgggaaacgaagtacgcgtccgttatgcaccgagtccaaccggacatttgcatattggaaatgccagaacggcgctttttaattatttatttgcccgcaatcaaggcggtaagtttatcattcgagttgaggatacagataaaaagcgcaatattgagggcggagaacaaagccagctgaattatctgaagtggctaggtattgactgggatgagagtgtggatgtcggaggagagtacggcccataccgtcagtccgagcgtaacgatatctataaagtgtactatgaagagcttcttgaaaaagggcttgcttataaatgttactgtacggaagaagagcttgaaaaagagcgtgaagaacagattgcccgcggagaaatgcctcgttattccggaaaacacagagacctgactcaggaagaacaggagaaatttatcgctgaaggcagaaaaccaagtattcgtttccgcgtgccggaaggaaaaatcatcgccttcaatgatatcgtaaaaggcgaaatttcttttgaatcagatggcatcggcgactttgttattgtgaaaaaggacggaacgccgacttacaacttcgcggtagcgattgatgactacttaatgaaaatgacacacgtgctgcgcggtgaggatcatatttctaacacaccgaaacagattatgatttatcaagcattcggatgggatattcctcagttcggacacatgacgctgatcgtaaacgaaagccgtaaaaagctcagcaaacgtgatgaatccattattcaattcatcgagcagtacaaagagcttggctacctgccagaagcgctgttcaactttatcggactgctaggctggtcaccggttggagaagaagagcttttcacaaaagagcagtttattgaaatttttgatgtaaatcgtttatctaaatcaccagctttgtttgatatgcataagctaaaatgggttaacaaccaatatgtgaagaagctggatcttgatcaggttgttgaactgacgcttccgcatttgcaaaaagcgggcaaagttggcactgagctttctgctgaagaacaagagtgggttcgtaaactgatttccctgtatcatgagcaattaagctacggtgcggaaattgttgagctgactgatttgttctttacggatgagatcgagtataatcaagaagcgaaagctgttctggaagaagaacaggttcctgaagtgctcagcacattcgcagcgaagcttgaagagcttgaggagttcactccggataatatcaaagcatcaatcaaagcagtgcagaaagaaactggccataaagggaaaaaactgtttatgccgattcgtgttgctgtaacagggcaaactcacggtccggaactgccgcaatcaattgaattgatcggtaaagagactgcaattcagcgtttaaaaaatatctaaataaatgattgttgacagggaagagtataaagctttaggccattacagaaaggatctccattggctgagagagatccatgagccgggttttagaagtgcgcccttaagacctttgaagaacgttttttgaaaccagtattcaaaggcggccgccgccgttacaggctgaagttgggagagcagaagtctgcttttcaaacagagtggaaccgcgcggttaaagcgtctctgtcatgtttacatgcagaggcgctttttttattgggtagaggaaatcagatagagaaacgggggaagcatgtgttttttagaatgctcaaagaagacattgatactgtgttcgatcaagatcccgcagcaagaagctattttgaagtgattttaacttattccggtttacatgctatatgggcgcatcggattgcacatgctttatataaacgaaaattttatttccttgcacgccttatatctcaagtaagccgattttttaccgggatagaaatccaccccggcgctacaatcgggagaagatttttcatagaccacggcatgggggttgtcattggggagacatgtgaaatcggcaataacgtaaccgtttttcagggggttaccctcgggggaacggggaaagaaaagggaaaaaggcacccaacgattaaagatgacgcattgatagccacaggtgctaaagtgctcggttctattacggtcggtgaaggctcaaagattggggctggttcagtagtgctgcatgatgttcctgatttttcaacagttgtcggtatccctggacgggtcgttgtacaaaatggcaaaaaagtaagacgcgatttaaaccatcaggatttgcccgatccagttgctgaccgctttaagtctttggaacagcagattttagagctgaaggcagaacttgaagacagaaaagaaaggatcaaccaaaaatgacaatcacactttataatacattgactagacagaaggaaacgtttgttcctcttgaagagggaaaagtgaaaatgtatgtatgcggacccacggtttacaattatattcatatcgggaacgcgcgtccggcaatcgtttacgatacggttcgaaactatttagagtataaaggctatgatgtgcagtatgtctctaacttcacagacgtagacgataaattaattaaagcggcaaatgaactcggtgaggatgtacccaccatttcagagcgttttattaaagcatactttgaagacgtaggtgcgctcggctgccgaaaagccgaccttcatccgcgagtaatggagaacatggatgccattatcgaattcgtagatcagctcgtgaaaaagggctacgcatatgaatcagaaggtgacgtatatttcaaaaccagagcatttgaagggtacggaaagctttctcagcaatcaatcgatgaacttagatcaggtgcacgcatccgagtcggcgagaaaaaagaagatgctcttgatttcgcattgtggaaagcggcaaaagaaggagaaatctcttgggatagcccttgggggaaaggacgtccgggctggcacattgaatgctcagcaatggtgaaaaagtatctcggtgaccagattgatatccatgcaggcggacaggatttaacattccctcaccatgaaaacgaaattgcgcaatctgaggcgctgacaggcaaaacgtttgcgaagtactggcttcataatggctatatcaatattgataatgaaaaaatgtcaaaatcactaggcaactttgtgcttgtccatgacatcattaaacagcatgatccgcagcttttgagattctttatgctatctgttcattatcgccatccgattaactattcagaagaacttctagaaaatacgaaaagcgcatttaaccgtttaaaaacagcgtacagcaatcttcagcaccgtctgaacagcagtacgaatttaacggaagatgacgatcaatggcttgagaaagttgaagaacaccgcaatgcattcgaagaagcgatggacgatgattttaatacggcgaatgcgatttctgtcttgttcgacttagcgaaacacgccaattactatcttcagaaagaccatacagctgatcatgtaattacggcgtttatcgagatgtttgaccgcattgtttctgtcctcggtttttcgttgggtgagcaggaacttctcgatcaagagattgaagacttaatcgaaaagcgaaatgaagcgcgccggaatcgcgattttgcattgtcagaccagatccgcgaccagctgaaaagcatgaatatcattcttgaagatacggctcaaggcactcgctggaaacggggagaataacagatgcttgaatttgatacgataaaagattctaagcagcttaacggtcttgcgcttgcttatataggtgatgccatttttgaagtgtatgtcaggcatcacctgcttaagcagggctttaccaaaccaaatgatcttcataagaaatcaagccggattgtttcagcaaagtcacaggctgagatcctattttttctgcagaatcaatcattttttacggaagaagaggaagcggtgctgaaaagaggcagaaatgccaagtcagggacaacacctaaaaatacagatgttcagacgtaccgctacagtacagcatttgaagcgcttctgggctacctttttctagagaaaaaagaggaacgacttagtcagctcgtagccgaagctatacaattcgggacgtcagggaggaaaacaaatgagtcagcaacatgattacgtcatagggaaaaatgcagtgatcgagacgttaaaatctgatcggaagctgtataagctgtggatggcggaaaacaccgtaaagggacaagcacagcaagtgattgagcttgccaaaaagcagggaatcacgattcaatacgtcccgagaaaaaaactcgatcaaatggtgacaggacagcatcagggcgtagtggcacaggttgcagcgtatgaatatgcagaactggacgatttatataaagcagccgaagaaaaaaatgaacagcctttcttcctcattctggacgagcttgaagaccctcataatcttggttccattatgaggacagcagatgcggtcggcgctcatggcatcgtcattccaaaacggagagctgtcgggctgacaacaacagtggcaaaagcttcaacaggagcaattgagcacattcctgtagcaagagtcaccaatttggcacggacgttagaagagatgaaagagcggggaatctgggttgtcggaacggatgcgtccgcgcgtgaggattaccgtaatatggacggcaatatgcctttggctctagtcatcggaagtgaaggaaaagggatgggccgccttgtgaaagaaaagtgcgattttctcattaaactcccgatggccggaaaggtaacttcactaaatgcatctgtcgcggctggtcttttgatgtatgaagtctaccggaaacgaaaccctctgggagaataaagacccatggatatcctgttagtagacgggtacaacatgattggagcctggccgcagctgaaggatttaaaagcgaacagttttgaagaggcgagagacgtactgattcagaaaatggcggaatatcaatcgtatacaggaaacagggttattgttgtttttgacgcgcatctcgtaaaagggcttgagaaaaaacagaccaaccatagagttgaagtaatttttacaaaagaaaatgagacggctgatgagcggatagaaaagctcgctcaggctttgaataatattgcgactcaaattcacgttgcgacctctgactatactgagcagtgggcgattttcggacagggggcattgcggaaatcggcccgggagcttttgagagaggtagaaacgattgaaaggcgaatagagagacgggtaagaaaaatcacttccgaaaagccggcgggtaaaattgctttatcggaagaggttttgaaaacgtttgaaaagtggaggcggggagacttagattaagttgacgcttttttgcccaatactgtataatatttctatctacgtgcgccgggggatcggagtgaatctacagaacaacaagggaaaattcaacaaagagcagttttgccagttggaggacgagcaggtcattgaaaaggttcatgttggggacagtgatgcgttagattacttgattacgaagtaccgaaactttgttcgggcaaaagcaagatcctatttcttaataggggcggacagagaggatattgttcaggaaggcatgataggcctctataagtctattcgtgacttcaaagaggacaagcttacctcattcaaagctttcgcagaattatgtattacccgccaaattattaccgcaataaagacagctactcgccagaaacacattcctttgaattcctacgtctcattagataaaccgatttttgatgaagaatcagaccgaacgctgctggatgtcatttcaggagcgaaaaccttaaatcctgaggaaatgatcattaatcaggaagaatttgatgatattgaaatgaaaatgggagaacttttaagtgatttagagagaaaagtactcgtcttatatctcgatgggagaagttaccaagagatttctgatgaactgaaccgacatgtgaaatcgatcgacaatgcccttcagcgtgtgaaacgcaagctggagaagtacttggaaattcgcgaaatcagtttgtaatagcaatttatgctatattgacagtatttttctgactatgatatgttactaaagataagaactaatgtctatttagaaaaaggtgtaatgacatgagaaaaaagattacgttagcatgcaagacatgcggaaaccgtaattatacgacaatgaagagctctgcatcagcggctgagcgattagaagtaaagaaatactgcagtacttgcaattcacatacagctcatcttgaaacaaaatagtttttgcgcttttaaattgtggaggtcttttacatgcgtattatgaaattctttaaagatgttgggaaagaaatgaaaaaggtaagctggcctaaaggaaaagagttaacgcgttataccattacggtaatttcaacagttatcttttttgttatcttttttgccctccttgacacaggaatttctcaattaattcgtttaatagttgaataatgatcagcaatacgtgctataatagatcataatattacttgccaaaacccgttcagcgggttttttattgtggcttaaaatgaaagttatcataggcttgccgcctatttttttgaagcgttatggtaattcactaaaaccaaatgcggggagggaaggactggacagtcctgaatagaatggaaaagaattggtatgttgttcacacgtactctggttatgagaataaagtaaaagccaacttggaaaagcgtgttgaatcaatggggatgcaggataaaattttccgtgtagtcgtacccgaagaagaagaaacggatatcaaaaacggcaagaaaaaagtcgtgaaaaagaaagtattccctggttatgtgcttgttgaaattgtaatgacagacgactcttggtatgtcgtccgcaacacgccgggcgttactggattcgtaggatctgccgggtcaggttcaaaaccgacgccgcttcttccgggggaagcagaaaccattctgaagagaatgggcatggatgaacgaaaaactgatattgactttgaactgaaagagacagtgaaagtaatagacggaccttttgctaactttacaggatcaattgaagagattgattatgataaaagcaaggtcaaagttttcgttaatatgtttggccgtgaaacgccggttgagctggaatttacccaaatcgataaattgtaatgtgaaaaaacttgaaattgctatatataaatgataatatagcaaaggtacgtcttggacttatccaaggcaactagcatgatatttcgtcattcatataaagaatgaaaccttgagtgggagggtttaccctattaccacatcacggacttaaggaggtgtgtctcgtggctaaaaaagtagttaaagttgtaaaattgcaaattcctgctggaaaagctaacccagcaccaccagttggacctgcacttggtcaagccggtgttaacatcatgggattctgtaaggagtttaacgctcgtacagctgaccaagctggtttaatcattcctgttgaaatttcggtttacgaagaccgttcatttacatttattacaaaaactccacctgctgcagtattgcttaaaaaagcagctggaattgagtctggttctggtgaaccaaaccgtaataaagtggcaaccgttaagcgcgataaagtacgcgaaatcgctgaaacgaaaatgcctgacttaaacgcagcagacgttgaagcggcaatgcgcatggttgaaggtactgcccgcagtatgggtattgtaatcgaggattaatttgtttcttgtcgggttgcgagttttaacaagttcgcaacccttattcgtgggaggttattccgctataaccacataaggaggaaattttaaaatggctaaaaaaggtaaaaagtacgttgaagctgctaagcttgtagaccgttctaaagcttacgacgtctctgaagcagtagctctcgttaaaaaaacaaacacagctaaattcgacgctacagttgaagtggctttccgtttaggggttgaccctcgtaaaaacgaccagcaaatccgtggagcagttgtgcttccaaacggaactggtaaaactcagcgcgttctcgttttcgcaaaaggcgaaaaagcgaaagaagctgaagctgctggtgcagatttcgtaggcgatactgactacatcaacaaaattcaacaaggctggttcgatttcgatgttatcgtagctacacctgacatgatgggtgaagttggtaaaatcggtcgtgtacttggaccaaaaggtttaatgccaaaccctaaaactggtacagttactttcgaagttgaaaaagcgatcggcgaaatcaaagctggtaaagttgaataccgtgttgataaagctggaaacattcatgttcctatcggtaaagtttctttcgaggatgaaaaacttgttgagaacttcacaacaatgtacgatacaatccttaaagctaaacctgctgcagctaaaggcgtttacgtgaaaaatgttgctgtaacttctactatgggacctggtgtcaaagtagactcttcaacttttaacgtaaaataatattgacatgacatcaacattctgatattattcaaaatgttgtaaaatagaatatcatttataccgtagacagtaggggcctaaccgcttaattatcctaccgaggtgtatattatcacagctattacgttacgtatgcttgtatatacagcctccatgtctcatggaggctttttatatggaatccgtcgtctcagtcgtgatcacctaacggtataagtgttacacaagaatctacaggaggtgtaaccatgagcagcgcaattgaaacaaaaaaagttgttgttgaagaaattgcttctaaactgaaagaaagtaaatcaacgatcatcgttgactatcgcggacttaacgtttctgaagtaactgaacttcgtaaacagcttcgcgaagctaacgttgagttcaaagtttacaaaaatacgatgactcgccgtgcggttgaacaagctgagcttaatggtttgaatgatttcttaactggaccgaacgcgatcgcattcagcactgaagatgttgtcgctccggctaaagttcttaatgacttcgctaaaaatcacgaagctcttgaaatcaaagctggcgttatcgaaggtaaagtttctactgttgaagaagtgaaagctcttgctgaacttccatcacgcgaaggcttgctttctatgttgcttagcgtacttcaagctccagttcgcaaccttgctcttgctgcaaaagctgtggcagaacaaaaggaagaacaaggcgcttaatctaatcagtttttcataaattaaaacaaaatggaggaattacaaatggctttaaatatcgaagaaatcattgcttccgttaaagaagcaactgtacttgaattgaacgacctagtaaaagcaatcgaagaagaatttggcgtaactgctgctgctcctgtagctgtagctggcggagctgctgctggcggagctgctgaagagcaaagcgaattcgatcttatccttgctggtgcaggatctcaaaaaatcaaagttatcaaagttgtacgtgaaatcactggtcttggcttgaaagaagctaaagaacttgttgacaacactccaaaaccacttaaagaaggtattgctaaagaagaagctgaagagcttaaagctaaacttgaagaagttggcgcttctgtagaagttaagtaatcttcacttacctgtaggggaagctcgcttttatgaggcgagctttttctttgccattctttaagccatgaaaaaaggaggttctaataatgagtgagcactattattcagaaaaaccttcagtgaaaagcaacaagcaaacctggtcttttaggcttcggaataaagatttcacgtttaccagcgacagcggggttttttctaaaaaagaagttgatttcggctcccgcctgctgattgattcttttgaagagcctgaggttgagggcggcattttggatgtaggctgcgggtacggcccgattggtttatcgctcgccagcgactttaaagaccggactatccacatgattgacgttaatgagagagccgtagaactatcaaatgaaaatgcggaacagaacggaataacaaacgttaagatttatcaaagcgatttgttttcaaacgttgattctgctcaaacatttgcttctattcttacaaatcccccaatccgagccggaaaaaaagttgtccatgctatctttgagaaaagcgctgaacacttaaaagcttcaggtgaattgtggatcgtcatacagaaaaagcaaggcgcgccttctgccattgaaaagctcgaggaactgttcgatgaagtttccgtcgttcaaaaaaagaaaggctattatatcataaaagcaaaaaaagtttgactcggtattttaactatgttaatattgtaaaatgccaatgtatatattttgcttgatatgatgaattgtcaatatctatgtataaattatacaagtatggaaatgctaataaaatcggtatttgtttttggatgtggttttcttaattagaaacccttttttcttttgtcttgtaaaagtattttctttctttggaagaaatgcttattacacatataatacgcatgatttgaggggtgaatcagttgacaggtcaactagttcagtatggacgacaccgccagcgcagaagctatgctcgcattagcgaagtgttagaattaccaaatctcattgaaattcaaacctcttcttatcagtggtttcttgatgagggtcttagagagatgtttcaagacatatcaccaattgaggatttcactggtaacctctctcttgagttcattgattatagtttaggtgagcctaaatatcctgtagaggaatcaaaagaacgtgatgtgacttactcagctccgctaagagtgaaggttcgtttaattaacaaagaaactggagaggtaaaagaccaagatgtcttcatgggtgatttccctattatgacagatacaggtacttttatcattaacggtgcggaacgtgttatcgtttcccagcttgttcggtctccaagtgtatatttcagtggtaaagtagacaaaaacggtaaaaaaggttttaccgcaactgtcattccaaaccgtggcgcatggttagaatacgaaactgatgcgaaagatgttgtttatgtccgcattgatcgcacacgtaagttgccggttacggttcttttgcgtgctctcggcttcggctccgatcaagagattcttgatctcataggagaaaacgaatacctgcgaaatacgcttgataaagataacacagaaaacagcgacaaagcgttgctggaaatttacgagcgtctccgtcctggagagccgcctacagtagaaaatgcgaaaagcttgcttgattctcgtttctttgatccgaaacgatacgatcttgccaatgtaggacgctataaaattaataaaaaacttcatattaagaatcgcctcttcaatcagagacttgctgaaacgcttgttgatcctgaaacaggagaaatccttgctgaaaaaggccagattcttgatagaagaacacttgataaagtactgccatacttagaaaacggaatcggttttagaaagctgtatccgaatggcggcgttgttgaagatgaagtgactcttcaatcaattaaaatctttgctccgactgatcaagaagaacaggttattaatgtaatcggcaatgcttacatcgaagaagagattaaaaacatcacgcctgctgatattatttcttcaatcagctacttcttcaacttgctgcacggagtaggcgacacagatgatatcgatcatcttggaaaccgccgtttacgttctgtaggcgagcttctccagaaccaattccgtatcggtttaagccgtatggagcgtgtggttcgtgagagaatgtcaattcaagatacgaatacaattacgcctcagcagctgatcaatattcgtcctgttattgcgtccattaaagagttctttggaagctcacagctttctcaattcatggatcagacgaacccgcttgctgaattaacgcacaagcgtcgtctgtcagcattaggaccgggcggattgacacgtgagcgtgccggaatggaagtgcgtgacgttcactactcccactatggccgtatgtgtccgattgaaacgcctgagggcccgaacatcggtttgatcaactcactatcatcttatgcaaaagtaaaccgttttggctttattgaaacgccatatcgccgcgttgaccctgaaacagggaaggtaacgggcagaatcgattacttaactgctgatgaagaggataactatgttgtcgctcaagcgaatgctcgtcttgatgacgaaggcgcctttattgatgacagcatcgtagctcgtttccgcggggagaacactgttgtttccagaaaccgtgtagactacatggatgtatcgcctaagcaggttgtatctgctgcgacagcatgtatcccgttcttagaaaacgatgactccaaccgtgccctcatgggagcgaacatgcagcgtcaggctgtgcctttgatgcagccggaagcgccatttgttggaactggtatggaatacgtatcaggaaaagactctggtgccgctgttatttgtaaacaccctggtatcgttgaacgcgtagaagcgaaaaacgtttgggttcgccgttatgaagaagtagacggtcaaaaagtaaaaggaaacctggataaatacagcctgctgaaatttgtccgctctaaccaaggtacgtgctacaaccagcgtccgatcgtaagtgtcggcgatgaagtggtaaaaggagaaatccttgctgacggtccttctatggagcttggtgaacttgcacttggccgtaacgtaatggtcggcttcatgacatgggatggctacaactatgaggatgccatcatcatgagtgaacgcctagtgaaggatgatgtttatacatctatccacattgaagaatacgaatcagaagcacgtgatacgaaacttggacctgaagaaatcactcgcgatattccaaacgtcggtgaagatgcgcttcgcaatcttgatgaccgcggaatcatccgaattggggcagaagtaaaagacggagatcttcttgttggtaaagtaacgcctaaaggcgtaactgaactgactgcagaagaacgccttcttcacgccatctttggcgagaaagcccgcgaggttcgtgatacttctcttcgtgtgcctcatggcggcggcggaattatccatgacgttaaagtcttcaaccgtgaagacggagacgaacttcctccaggtgttaaccagttagtacgcgtatatatcgttcagaaacgtaagatttctgaaggggataaaatggccggtcgtcacggtaacaaaggtgttatctctaagattcttcctgaagaggatatgccttaccttcctgacggcacaccaattgatatcatgcttaacccgctgggcgtaccatcacgtatgaacatcgggcaggtattggaacttcacatgggtatggccgctcgttaccttggcattcacattgcatctcctgtatttgacggagcgcgagaagaggatgtctgggaaacacttgaagaagccggcatgtctcgtgacgccaaaacagtgctttacgacggacgtactggagagccgtttgataaccgtgtatctgtcggtatcatgtacatgatcaaactagctcacatggttgacgataaacttcatgcacgctctacaggtccttactcacttgttacgcagcagcctcttggcggtaaagcgcaatttggcggacagcgttttggtgagatggaggtttgggcacttgaagcttacggtgcggcttatactcttcaagaaattctgactgttaagtctgatgacgtggttggacgtgtgaaaacatacgaagccatcgttaaaggcgacaatgttcctgaaccaggtgttccggaatcattcaaagtattaatcaaagaacttcaaagcttaggtatggatgtcaaaatcctttctggtgatgaagaagaaatagaaatgagagatttagaagacgaagaagatgcgaaacaagctgacggcctggcattatcaggtgatgaagagccggaagaaacagcatctgcagacgttgaacgcgatgtagtaacaaaagaataatctctagttataaaggcaagtgacatcggttaatccgaagataaaaagggaggtaggcccttgctagatgtgaacaattttgagtatatgaacatcggtcttgcttcaccagataaaatccgttcatggtcttttggtgaagtgaaaaagcctgaaacgataaactatcgtacgttaaaacctgaaaaggacggtctattctgcgaacgcattttcggacctactaaggactgggaatgtcattgcgggaagtacaagcgagttcgttataaaggcgtagtttgtgaccgttgcggagtcgaagtaacacgggctaaagtccgtcgtgagagaatggggcacattgaactggctgccccagtttcccacatttggtatttcaaaggtattccaagccgtatgggtcttgtgctggatatgtcacctcgtgctttagaagaagtcatttactttgcttcttacgttgtaactgatccggcgaatacaccgcttgaaaagaaacagcttctgtctgagaaagaatatcgtgcttatcttgataaatacggtaataaattccaagcatctatgggtgctgaagcaattcataaacttcttcaagatatcgatcttgtcaaagaagttgatatgttaaaagaagagctgaaaacttcacaaggacaacgacgtactcgtgcgatcaaacgtcttgaagttttagaagcctttcgtaactcaggaaacaagccttcttggatgatccttgatgtgcttcctgttattcctccggagcttagaccgatggttcagctagatggcggacgttttgcgacttctgatttgaatgacctttatcgtcgtgtcatcaaccgtaacaatcgtttgaaacgccttttggaccttggtgcgcctagcatcatcgttcaaaacgaaaagcgtatgcttcaagaggctgtcgatgccttaattgacaacggccgccgcggacgccctgtaacaggccctggtaacagaccgttaaaatctctttctcacatgctgaaagggaagcaaggccgtttccgtcaaaaccttcttggtaaacgtgtcgattactccggacgttctgtaatcgttgttggtcctcatttgaaaatgtaccaatgcggattaccgaaggaaatggcgcttgaacttttcaaacctttcgttatgaaagaacttgttgaaaaaggtcttgctcacaacattaagagtgcgaaacgcaaaattgagcgcgtacagcctgaagtttgggatgtactagaatcagttattaaggagcatccggtactgctgaaccgtgcccctacacttcacagattaggtatccaggcgtttgaaccaacgcttgttgaaggacgcgcaatccgtcttcacccgctcgtatgtacagcttacaacgctgactttgacggtgaccaaatggcggttcacgtaccattatctgctgaagcacaagctgaagcacgcatcctgatgcttgctgctcaaaacatcttgaaccctaaagatggtaaaccggttgtaacaccgtctcaggatatggtactaggtaactattacctgacacttgagcgtgccggtgctgtcggtgaaggtatggtcttcaagaatacagacgaagcgcttcttgcttatcaaaacggatatgttcaccttcatacgagagtagctgttgcagctaactcacttaagaatgtgacatttaccgaagaacagcgctcaaaattgttaattacaactgtcggtaagcttgtcttcaatgaaattcttccggaatcattcccttacatgaatgaaccaacgaagagcaacattgaagagaaaacacctgaccgtttcttcttagaaaaaggtgctgacgttaaagctgttatcgcacagcagccaatcaatgcgccgtttaaaaaaggcattctgggtaaaatcatcgcggaaatctttaaacgattccatattacggaaacgtctaaaatgcttgaccgcatgaaaaacctaggtttcaaatattcaactaaagctggtattacagttggggtttctgacatcgtcgtactcgatgataaacaagaaattcttgaggaagcgcaaagcaaagttgacaacgttatgaagcagttccgccgcggtcttatcactgaagaagaacgctatgagagagtcatctctatctggagtgctgcaaaagacgttatccaaggcaaactgatgaaatcacttgatgaactcaacccgatctacatgatgagtgactctggtgcccgtggtaacgcatctaactttacgcagcttgccggaatgcgcggcctgatggccaacccggctggacgtatcattgagttgccgatcaaatcaagtttccgtgaaggtctgacagtattggagtactttatctccacacacggtgcgcgtaaaggtcttgccgataccgctcttaaaactgctgactcaggttaccttacacgccgtctcgttgacgttgcgcaggatgttatcattcgtgaaactgattgcggaactgaccgaggcattcttgctaagcctcttaaagaaggaactgaaacaattgagcgcttagaagaacgcttaatcggacgttttgcaagaaaacaagtgaagcaccctgaaacaggtgaagtgcttgtgaatgaaaacgaactgatcgatgaagataaagctctggaaattgtcgaagccggcattgaagaagtgtggatccgttctgccttcacatgtaatacgcctcatggtgtatgtaaacgatgctatggccgaaatctcgctactggctccgatgttgaagtcggtgaagctgtcggaatcattgctgcccaatcaatcggtgagcctggtacacagttaacaatgcgtacattccatacaggcggggttgccggagacgatatcacacagggtcttccgcgtatccaagagcttttcgaagcgcgtaatccgaaaggtcaggcaacaattacagaaatcgacggtacagtcgttgagatcaatgaagttcgtgataagcaacaggaaattgtggttcaaggcgcagtggaaacacgttcttatacggcaccttacaactcccgcctgaaagtagcggaaggagataaaattactcgaggccaagtactgacagaaggttcaatcgatccgaaagaacttcttaaagtgactgacctgacgactgttcaagagtatcttctccatgaggttcaaaaggtttaccgtatgcagggtgttgaaatcggtgataaacacgtagaagtaatggttcgccagatgcttcgcaaagtacgcgtaattgatgccggtgacactgatgtgcttccaggtacattgcttgatattcaccaatttactgaagcaaacaaaaaggtattacttgaaggcaatcgacctgctacaggccgtcctgtcttactcggtattacaaaagcatctcttgaaactgattcattcttatctgctgcttccttccaggaaacaacacgtgtccttacagatgcagcgatcaaaggtaagcgtgacgagcttctcggcttgaaagagaatgttatcatcggtaagcttgttccagctggtacaggaatgatgaaataccgtaaagtaaaaccagtatcaaatgttcagccgactgacgatatggtcccggttgaataactgatttaatgctgctgaaagactgcaaaaacagtctttcagcagatatatttatgaaaaagtcactctatgagaagaacgaaactaaaaaatgtcataccttgttgacattcgtctcctagaatgataatataaccaaggtgctcgaaataaacctgttactttggaggatatgtttatgtcttatgataaagtatcacaggccaaatcaattattattggtacgaagcaaacagtgaaagctctaaagcgaggttcagtaaaggaagtagtcgttgcaaaagacgcagatccgatactcacgtcaagtgttgtttcacttgctgaagatcaaggtatctctgtctcaatggttgaatccatgaaaaagctcggcaaagcctgcggaattgaggtaggagcagccgctgttgccattattttataacgtacttttgtttttgcgtaagattccatcttgtgtaaagacattgttttttgccttttgatgaaccacctgggtatgtgggttataaaacgtaatgaagggaggaaaaattcatgcctacaattaatcagctaattcgcaaaggacgcgtgagtaaagtagaaaactcaaagtctcctgcacttaacaaaggatacaacagctttaaaaaagagcacactaacgtatcttctccacaaaaacgcggggtatgtactcgtgttggtacaatgacaccgaaaaaaccgaactcagcacttcgtaaatatgctcgtgttcgtttgactaacggaatcgaggttactgcttacattcctggtatcggtcacaacctgcaagagcacagtgttgtacttatccgcggcggacgtgtaaaagacttaccaggggtacgttaccacatcgttcgtggtgcgcttgatactgctggagttgaaaaccgtgcacaaggccgttctaaatacggtacgaaaaaacctaaagcaaaataatatacgaaaatacgcataattgatgaagggaggatattcagatgccacgtaaaggtcctgtagcaaaaagagatgttttacctgatccgatttacaactctaagcttgtatctcgtctaatcaacaaaatgatgatcgatggtaaaaaaggtaagtctcaaacaatcctatacaagtcattcgatatcattaaagaacgtactggcaatgatgcaatggaggttttcgaacaagcattgaaaaacatcatgcctgtacttgaagtaaaagcacgccgtgtaggtggtgcgaactaccaagttcctgtagaagttcgtcctgaacgtcgtacgactcttggacttcgctggttagttaactacgctcgtcttcgcggagaaaaaacgatggaagagcgtttagctaacgaaatccttgacgcagctaacaacactggtgctgctgttaagaaacgtgaagacactcataagatggctgaagcaaacaaagcatttgctcactatcgctggtaggatttatagattaacaaaacacaatttcctaataaggaaggagaaattacccaatggcaagagagttctccttagaaaaaactcgtaatatcggtatcatggctcacatcgatgccggtaaaacgacaactacagaacgtatcttgttctatactggtcgtatccacaaaattggtgaaactcatgaaggagcttcacaaatggactggatggagcaggaacaagaacgtggtatcacaatcacttccgctgcgacaactgcacagtggaaaggataccgcgtaaacatcatcgatactccaggacacgtagacttcacagttgaagttgaacgttctcttcgtgtacttgatggtgctgttgctgtacttgacgcgcaatcaggcgttgagcctcaaacagaaactgtttggcgtcaggcaacaacttatggagtaccgcgtatcgtttttgttaacaaaatggacaaaatcggtgcagacttcctttactctgtaggaactttaagagaccgtcttcaagcaaacgctcatgcaattcaattgccgatcggtgctgaagataacttcgaaggtatcattgaccttgtagaaaacgttgcgtatttctacgaagatgacctcggaactcgttctgatgcaaaagaaatccctgaagagtacaaagagcaagctgaagagcttcgcaacagccttattgaagctgtatgtgagcttgatgaagagcttatggataagtaccttgagggtgaagaaatcacaattgatgagttaaaagcaggaattcgtaaaggtacattaaatgttgaattctaccctgttcttgttggttctgccttcaaaaacaaaggtgttcaactagtacttgatgctgttcttgactaccttcctgcaccaactgacgttgctgcaatcaaaggtacacgtcctgatacaaatgaagagattgagcgtcattcttctgacgaagagccattctctgcattagcatttaaagttatgactgacccttacgttggtaagttgacgttcttccgtgtgtactctggaacacttgattctggttcatacgtgaaaaactctactaaaggcaaacgtgagcgtgttggacgtattcttcaaatgcacgctaacagccgtgaagaaatctctactgtatacgcaggggatatcgcagctgctgtaggtctaaaagatacaactactggagatactctatgtgatgagaaggatcttgttatccttgagtcaatggaattcccagaaccagttatcgacgttgctattgagcctaaatcaaaagctgaccaagataaaatgggtatcgctttagcgaaacttgctgaagaagatcctacattccgtactcaaacaaacccagaaactggccaaacgatcatctctggtatgggtgaacttcaccttgatatcattgttgaccgtatgaaacgcgaatttaaagtagaagccaacgttggtgctcctcaagttgcgtaccgtgaaacattccgtaccggtgcaaaagttgaagggaaattcgtacgtcagtctggtggacgcggtcagttcggacacgtttggatcgaattcgaaccaaacgaagaaggcgctggctttgaatttgaaaatgcgattgtcggtggggttgttcctcgtgaatacatcccagctgttcaagcaggtctggaagatgcacttgaaaatggtgtactagcaggcttcccgcttatcgacattaaagctaaacttttcgacggttcttaccatgatgttgactcaaacgaaatggcatttaaagttgctgcttctatggcattgaaaaatgcagtcagcaaatgtaacccagttcttcttgaaccaatcatgaaagtggaagtggttattccagaagaatacatgggagatatcatgggtgatatcacttcacgtcgcggacgcgtagaaggtatggaagcacgcggtaacgctcaagttgttcgcgctatggttcctcttgctgaaatgttcggttacgctactgcacttcgttctaatacgcaaggtcgcggtacgttcactatgcacatggatcactacgaagaagtgccgaagagcgtcgcagaagaaattatcaaaaaaaataaaggcgaataattgattttgccgcttaactcaagtataactactattgtaagatgaggaagtgaaagctttctttcacttcctatcactctatacattactaattaaaagctcttaaggaggattttagaatggctaaagaaaaattcgaccgttccaaatcacatgccaatattggtacaattggacacgttgaccatggtaaaacaactttaactgctgctatcacaacagtacttcataagaaatctggtaaaggtacagctatggcgtacgatcaaattgatggtgctccagaagaacgtgagcgcggtatcacaatctctactgcacacgttgagtacgaaactgaaactcgtcactatgcacacgttgactgcccaggacacgctgactatgttaaaaacatgatcactggtgctgcgcaaatggacggagctatccttgtagtatctgctgctgatggcccaatgccacaaactcgtgagcacatccttctttctaaaaacgttggtgtaccatacatcgttgtattcttaaacaaatgcgacatggtagacgacgaagagcttcttgaactagttgaaatggaagttcgcgatcttcttagcgaatacgacttccctggtgatgatgtaccagttgttaaaggttctgctcttaaagctcttgaaggagacgctgagtgggaagctaaaatcttcgaacttatggatgcggttgatgagtacatcccaactccagaacgcgacactgaaaaaccattcatgatgccagttgaggacgtattctcaatcactggtcgtggtacagttgctactggccgtgtagaacgcggacaagttaaagtcggtgacgaagttgaaatcatcggtcttcaagaagagaacaagaaaacaactgttacaggtgttgaaatgttccgtaagcttcttgattacgctgaagctggtgacaacattggtgcccttcttcgcggtgtatctcgtgaagaaatccaacgtggtcaagtacttgctaaaccaggtacaatcactccacacagcaaattcaaagctgaagtttacgttctttctaaagaagagggtggacgtcatactccattcttctctaactaccgtcctcagttctacttccgtacaactgacgtaactggtatcatccatcttccagaaggcgtagaaatggttatgcctggagataacactgaaatgaacgttgaacttatttctacaatcgctatcgaagaaggaactcgtttctctattcgtgaaggcggacgtactgttggttcaggtgttgtttctacaatcactgagtaatagtatgattttaaacgagacccctgcgggtctcgttttttgtttgcttatctttttcttgtataataggatctatcatattcgaggggctaatatttatgattcctgaaaagaaatcaatcgcaatcatgaaagaactaagcattgggaatacaaagcaaatgctaatgattaatggagttgatgtgaaaaatccattgctgctttttttacatggcgggccgggaacgccgcaaatcggatatgttagacattatcaaaaagagctggaacagtattttacagtagttcattgggatcagagaggatcggggctttcttattctaagcgaatttcgcatcactctatgacaataaatcacttcattaaagatacaatccaagtcactcaatggcttttagctcatttttcaaaatcaaaactttacctagccggtcattcgtgggggtcaatactggcgcttcatgtgctgcagcagtgtcctgatttattttacgcgtattatggaatcagccaggttgttaaccctcacgatgaagaatcaactgcttatcaacatattcgtgaaatttctgaatcaaaaaaagccagcttattatctttcctcacacgtttcattggtgctccgccttggaagcaggatatccagcaccttatctatcggttttgtgtcgagcttagcaggggaggattcactcgtcgtcatcgtcaatctctagctgtaatatttcaaatgcttactggcaatgagtatggagtgcggaatatgcacagcttctttaatggattgcgcttcagtaaaaaacatttaactgatgagttgtaccggtttaatgcttttacatcagttccttctattaaagtaccgtgtgttttcatttcagggaaacatgacttaattgttcctgctgaaatatcgaaacagtattatcataaacttgaggcacccgaaaagcgctggtttcaatttgagaactcagctcacaccccgcatattgaggaaccgtcattattcgcgaacacattaagtcgacatgcacgacaccatttatgatagatccttgataaataagaaaaacccctgtataataaaaaaagtgtgcaaaccatgcatattttaaataagtcttgcaacatgcgcctattttctgtataatggtgtatgttggtctttgactgcgatgaagtgagaggttgctgacacacccggccgctttgccatggcaaggtgttcaggtttttctcacggagaactgtctaacgtgatgtaggcgaaaaggagggaaaataatggcaaaacaaaaaattcgtattcgtttgaaagcatatgatcatagaatccttgatcaatctgcagagaagattgttgaaacggcaaaacgttctggtgccagcgtatctggtccgattccgttgccaactgaaaaatcagtttacacaatccttcgtgcggtgcacaaatacaaagattctcgtgagcaatttgaaatgcgtacacataaacgtttaatcgacattgtgaacccaacaccacaaactgttgatgctcttatgcgattagacttaccatctggtgtcgatatcgaaattaaactttaattctaaaatatagaatgatcttaataggaggtgtgacgaatgaccaaaggaatcttaggaagaaaaattggtatgacgcaagtattcgctgagaatggtgatcttattccggtaactgttattgaggctgctccaaacgttgttcttcaaaagaaaacagctgaaaacgacggttatgaagcaatccagcttggttttgacgacaagcgtgaaaagctttctaacaaacctgaaaaagggcacgttgcaaaagcggaaactgctcctaagcgcttcgttaaagaattacgcggagtggaaatggatgcgtatgaagttggtcaggaagtcaaggttgaaattttctctgctggagaaatcgtagatgtaacaggagtatctaaaggtaaaggtttccaaggtgcgatcaagcgccacggacaatctcgcggacctatgtctcacggttcacgctaccaccgtcgtcctggttcaatgggacctgtagatcctaaccgtgtattcaaaggtaaattattacctggacgtatgggcggagagcaaatcactgttcaaaaccttgaaatcgtaaaagttgatgcagaacgcaatcttcttttgatcaaaggtaacgtacctggtgcgaagaaatctttaatcactgttaaaagtgctgttaaatctaaataattctcttaggaaaggaggaaattgattatgccaaaagtagcattatacaaccaaaacggttctactgctggtgacatcgaattaaacgcttctgtatttggtatcgaaccaaatgagagtgttgtattcgacgctattcttatgcaaagagcttccttacgtcaaggaactcacaaagtaaaaaatcgttctgaagtacgcggcggaggtcgtaaaccatggcgtcaaaaaggtactggacgtgcccgtcaaggttcaatccgttcaccgcaatggcgcggaggtggtgtcgtattcggcccaacaccacgcagctattcttataaattacctaaaaaagttcgccgcttggcaatcaaatcagtattgtcttctaaagtgaacgacaacaacatcatcgttcttgaagatcttactcttgatacggctaaaacaaaagaaatggcagctatccttaaaggattatctgttgagaaaaaagctttaatcgtaactgcggatgcaaacgaagcagtagctttatctgctcgtaacattcctggagttactgttgttgaagctaacggaatcaacgttttagacgttgtcaaccacgagaagcttctgattacaaaagcagcggttgaaaaagtagaggaggtgcttgcataatgaaagatcctcgtgatgttctaaagcgccccgtcattactgaacgttctgctgatttaatgactgaaaagaaatatacttttgaagttgatgtaagagctaacaaaacagaagtgaaagacgcggttgaaagcatctttggagtgaaagttgacaaagtcaacatcatgaactacaaaggtaaatcaaaacgtgttggacgctacactggtatgactagccgtcgcagaaaagcgatcgtaaaacttactgcagacagcaaagaaatcgaaatttttgaagcttaattatctgtaaaaagaaggagggaaattcaaaatggcgattaaaaagtataaaccgacctctaatggacgtcgtggcatgacaacttcagattttgctgaaatcacgactgacaagccggaaaaatccttgcttgctccccttcacaaaaaaggcggacgtaacaaccaaggtaaattgactgtacgtcaccaaggtggcggacataaacgccaataccgtgttatcgacttcaaacgcgataaagatggtatacctggacgcgttgctacagttgaatacgatccaaaccgttcagctaacatcgctctaatcaactatgcagacggagaaaaacgttacattcttgctcctaaaggaattcaagtaggtactgaaatcatgtcaggtcctgaagctgacattaaagtaggtaatgcacttccacttatcaacatccctgttggtacagttgtgcataacattgaattaaaacctggtaaaggcggacagcttgtacgttcagctggtacatctgctcaggttcttggtaaagaaggtaaatacgttcttgtacgtcttaactctggtgaagttcgcatgatcctttctgcttgccgtgcttctatcggtcaagtaggtaacgaacagcacgaacttatcaacattggtaaagctggacgttctcgctggaaaggcatccgtcctacagttcgtggttctgtaatgaaccctaacgatcacccacacggtggtggtgaaggacgtgcgccaatcggacgtaaatcaccaatgtctccatggggcaaaccaactcttggattcaagactcgtaagaaaaagaacaaatccgataaatttatcgtacgtcgtcgtaaaaataaataacggggttgtctacggttcttttcggaccgtagtgcaatcacgaagggaggttccaaaatggctcgcagcttaaaaaaaggaccatttgtcgatggacacttgatgactaaaatcgagaaattaaatgaaacagacaagaaacaagtcgtaaaaacttggtctcgtcgttctactattttcccacagtttattggtcacacaatcgcagtctatgacggacgtaaacacgtgcctgtattcatctctgaagatatggtagggcacaagttgggtgaattcgctccaactcgtacgtacaaaggtcatgctagtgatgacaaaaaaacaagacgctaagagaggaggcttttaaatgcaagctaaagctgttgcaagaacagtccgtattgctcctcgtaaagcacgtctagtaatggacctgattcgaggcaagcaagtaggtgaggcagtatcaatcttgaaccttacaccaagagctgcttctccaattatcgagaaagtattaaaatccgctattgcaaatgctgagcataactatgaaatggacgctaacaacctggttatttctcaagcattcgttgacgaaggccctacgttaaaaagattccgcccacgtgctatgggacgtgcgagccaaattaacaaacgtacgagccacattacaatcgttgtatcagaaaagaaggagggataagtagtgggtcaaaaggtaaatccagtcggtcttcgtatcggagtcattcgtgattgggaatctaagtggtacgctggtaaagattacgctgacttcctgcacgaagatttaaaaattcgtgaatacattagcaaacgcctttctgacgcttctgtttctaaagtagaaatcgagcgtgcagcaaaccgcgttaacattacgatccacacagctaagcctggtatggttatcggtaaaggcggttctgaagtcgaagcacttcgcaaagcccttaacagccttactggcaagcgtgtacacattaacattcttgaaattaaaagagcagatcttgatgcacagctagttgctgacaacatcgctcgtcaattagaaaaccgtgtttctttccgccgtgcgcagaaacaacaaatccaacgtactatgcgtgctggagcacaaggtgtgaaaacaatggtttctggtcgtcttggcggtgcagatatcgctcgttctgaatactacagtgaaggaactgttccattgcacacattgcgtgcggacattgactatgcaacatctgaagctgatactacttacggtaagcttggtgtaaaagtctggatctatcgtggagaggttcttcctactaagaagaaaactgaggaaggaggaaaataatatgttattaccaaaacgcgttaaatatcgcagagagcatcgcggaaaaatgcgtggccgtgcgaaaggcggtactgaagtacatttcggagaattcggtatccaagctctagaagcttcttggattactaaccgtcaaatcgaagctgcacgtattgcgatgactcgttacatgaaacgtggcggtaaagtttggatcaaaattttcccttctaaaccttacactgctaaaccacttgaggtacgtatgggatccggtaaaggggctccagaaggttgggtagctgttgtaaaaccgggcaaagttttatttgaaatttctggtgtgtctgaagaggttgctcgtgaagcgcttcgccttgcatctcacaaattgccaattaaaacgaagttcgtaaaacgtgaagaaattggtggtgaatcaaatgaaagctaatgaaattcgtgaccttaccactgctgaaattgaacaaaaagtaaagtctcttaaagaagaacttttcaatcttcgctttcaattagcgacaggacaacttgaaaatactgctcgcattcgtgaagtgcgcaaagctatcgcgcgcatgaaaactgtgattcgtgaaagagaaattgctgctaataaataatcactgaggggaggtcgtgagcatgagcgaacgtaaccaacgcaaagtttaccaaggccgtgttgtttctgacaaaatggataaaaccattactgttgttgttgagacatacaaaaaacatacactttacggtaaacgcgtaaaatactcaaaaaaattcaaagcacatgatgaaaataatcaagctaaaatcggtgacatcgttaagatcatggaaactcgtccattgtctgcaactaagcgtttccgtctagttgaagttgtcgaagaagctgttattatctaataaagttcggaattctttttccgaagggaggtaacaaataatgattcaacaagagactcgtttaaaagtagctgacaactctggcgcacgtgaagtacttactattaaagttcttggtggttctggacgtaaaacagctaacattggtgatgtaattgtttgcacggttaaacaagcaacaccaggaggcgttgtcaaaaaaggtgaagtcgtaaaagctgttatcgttcgcactaaaagcggagcgcgcagaagtgacggttcatacatcagcttcgatgagaatgcatgtgttatcatccgtgacgacaagagcccacgcggaactcgtatcttcggaccagttgctcgtgaattgcgtgaaaacaactttatgaaaattgtttctctagctccagaagttatctaatgaaataaatgccttactcaaggaggtgcgatcaggatgcatgtaaaaaaaggcgataaagttatggttatctctggtaaagataaaggcaaacaaggaacaatccttgctgctttccctaaaaaggaccgcgttttagttgaaggtgttaacatggtaaagaaacactctaaaccaactcaagctaaccctcaaggcggtatttctaatcaagaggcgccaattcatgtatcaaacgttatgccgctcgatcctaaaacaggtgaagtgactcgcgtaggatacaaagtggaagatggcaaaaaagttcgtgtagcaaaaaaatctgggcaagttctagataaatagtattaaaaggaagggaggtctatctcatgaaccgccttaaagaaaagtacaataaagaaattgcacctgctttaatgactaagttcaactatgattcagtcatgcaagtgcctaaaatcgaaaaaatcgtaatcaacatgggtgttggtgacgctgttcaaaacgccaaagcaatcgacagtgctgttgaagaattaacgtttatcgcaggtcaaaaacctgtcgttactcgtgcgaagaaatcaattgctggattccgtcttcgtgagggaatgcctatcggtgcgaaagtaactcttcgcggagagcgcatgtatgatttccttgataaacttatttctgtatctttaccgcgtgtacgtgacttccgcggggtttctaaaaaatctttcgacggtcgcggtaactacacacttggtatcaaagaacagttaatcttccctgaaattgactacgataaagtaacaaaggttcgcggaatggacatcgttatcgtaacaactgctaatactgacgaagaagctcgtgagctattaactcaagtaggtatgccgttccagaaataatcaatgaaagggaggcgaaatcgtggctaaaaagtctatgattgcgaaacaacaacgtacaccaaagtttaaagtacaagagtacacacgctgtgaacgctgcggacgtccgcattcagtcattcgtaaatttaaactttgccgtatttgtttccgtgagcttgcatataaaggacaaattcctggcgtgaaaaaagccagctggtaatccccaagaaagggaaggaggtaattatataatggttatgacagatccaattgcagatatgctaactcgtattcgcaatgcaaacatggtacgtcatgagaagcttgaaattcctgcttctaaattgaaaagagaaattgctgaaattttaaagcgtgaaggtttcattcgtgacgttgagttcgtagaagacagcaaacaaggtatcatccgcgttttcttgaaatacggacaaaacaacgagcgcgttatcactggtcttaaaagaatcagcaagcctggtttgcgtgtttatgctaaatctaatgaagtacctcgcgtacttaacggtcttggaatcgcgattatttctacatcacaaggtgttttaacggacaaagaagcccgtgcaaaacaagctggtggagaagttctagcatacgtttggtaagaagtttaacatgaatggaggtgtttggtatgtctcgtgtaggtaagaagctacttgagattccttctgatgttacagtaacgttaaatgataacaacactgtagctgtgaaaggaccaaaaggagaattaactcgtacgtttcaccctgatatggagattaaagtagaggacaatgtgcttacagtcgctcgtccttctgatcaaaaagagcaccgtgccctgcatggtacgactcgcagtctgcttggcaacatggttgaaggtgtatctaaaggatttgaaagaggtttggaattagtcggtgtcggttaccgtgcttctaaatccggaaataaacttgttttaaacgttggatactctcatcctgttgagatcgttcctgaagaaggcatcgaaatcgaagttccttctcaaacaaaagtagttgtaaaaggtacagacaaagaacgtgtaggagctattgctgctaacatccgcgctgtacgttctccagagccttacaaaggtaaaggaatccgctacgaaggtgaagttgttcgccgtaaagaaggtaaatctgctaagtaagatcgcttaaagtgaagaaaggagtgacctagatgattacgaaaactagcaaaaatgctgctcgtcttaaaagacacgctcgtgttcgcgctaaactttccggtactgctgaaagaccgcgcctgaacgttttccgttctaacaagcacatttacgctcaaatcatcgatgatgtaaatggtgtaacacttgctagtgcatctactctcgataaagacttgaacgttgaaagcactggagatacttctgctgctactaaagttggagaattagttgcaaaacgcgctgctgaaaaaggcatttctgacgtagtatttgaccgtggcggatacttataccatggacgtgtaaaagctttggctgatgccgctcgtgaagctggacttaaattttaataaaagaaggagggacacatgattatgcgtcgtattgacccaagcaaattagagttagaagaacgcttagttacggttaaccgcgtagcgaaagttgttaaaggtggtcgtcgtttccgcttcgcagctctagtcgttgtcggtgacaaaaacggacacgtaggattcggtactggtaaagcacaagaagtaccagaagcgatccgcaaagctgttgaagatgcgaaaaagaatttgattgaagtaccaatggttggaactacaattccacacgaaatcatcggacgtttcggtgcaggtaacatcttgttaaaacctgcttctgaaggtactggagttatcgctggaggccctgtacgtgcggtacttgagctagctggtgtagctgatatcctttctaagtctttaggttctaacacaccgatcaacatgattcgtgcaacacttcaaggtttaagtgaacttaaacgtgctgaagacgttgcgaagcttcgtggaaaatctgtagaagaactgttaggataaggagggaacattaatggctaaattagaaattaccctcaaacgaagtgtaatcggtcgcccggaagaccaacgcgttactgtaagaacacttggtttaaagaaaacaaaccaaactgttgttcatgaagacaacgctgcgatccgtggtatgattaataaagtatctcatttagtttctgttaaagaacaataaaaatatttgatcggataaggaggtgtcctaatgaaacttcatgaattaaaaccttcagaaggttcacgcaaaacgcgtaatcgcgtaggtcgtggtattggttctggcaacggtaaaacagctggtaaaggtcacaaaggtcaaaacgctcgttctggcggcggtgtacgccctggattcgaggggggacaaatgcctttattccaacgtcttcctaaacgcggtttcactaacatcaaccgcaaggaatacgctgtagtcaacctagacaaattgaacggttttgcagaaggaacggaagtcactcctgaacttcttctagagactggtgttattagcaaacttaatgcaggagtaaagattcttggcaacggtaaattagagaaaaaattaactgtaaaagccaataaattctctgcttctgcgaaagaagctgttgaagctgctggcggtacagctgaggtgatctaacttgtttaaaacaatctccaactttatgcgtgtgagtgatatcaggaataaaatcatattcactttactcatgcttatcgtctttcgcataggtgcgtttattcctgtgccttacgttaacgctgaagcgttacaggcgcagtctcaaatgggtgtttttgatctccttaatacatttggcggcggtgcgctttaccaattttccattttcgcaatgggaattactccttatatcacggcttcgatcatcattcagctgcttcagatggatgttgtaccgaagtttaccgagtggtctaagcaaggtgaagttggccgccgtaaattagctcagttcacaaggtactttacgattgtgcttggtttcatccaagcattaggtatgtcatatggatttaacaatctggcaaacggtatgctgatcgaaaaatccggtgtatcgacatatcttatcattgctttagtgctcactggcggaactgcctttttaatgtggcttggggaacaaattacttctcatggagtaggcaacggaatatcgatcattatcttcgcggggattgtgtctagtattccaaaaacaattgggcaaatatatgagactcaatttgtcggcagcaacgatcagttgtttattcatattgtgaaagtcgcacttcttgtgattgcgattttagcagttattgttggagttattttcattcagcaagccgtacggaaaattgcgattcaatatgctaaaggcacaggtcgttcacctgctggcggaggtcagtctacacaccttccattgaaagtgaatcctgcaggggttattccggtaatctttgcggttgcgtttttgataacgccgcggacgatcgcgtcattctttggaacaaacgatgtgacaaagtggattcaaaacaactttgataatacgcatccggtgggtatggcgatatatgttgcgttgattattgcctttacgtacttttatgcttttgtacaggtaaaccctgaacaaatggctgataaccttaaaaaacagggtggctatatcccgggggttcgtccagggaaaatgactcaagatagaattacgagcattttgtatcgacttacgtttgtgggttctatattcttagccgtgatttccattcttcctatctttttcattcaattcgctggattgcctcaaagtgcacaaattggcggaacatctttgttaattgttgtcggggtagccttggagacaatgaaacaactagaaagccagttggtgaaacgaaactaccgtggatttatgaaaaactagaggaaatggatttatccattccctcttaataaagagaggacgggggaaatccgaatgaacttagtcttaatggggcttcctggtgccggtaaaggcacacagggcgaacgaattgttgaggattatgggattcctcatatctcaacaggagatatgttccgtgctgctatgaaagaagaaacaccactcggactcgaagcaaaatcttatattgataagggagagctcgtacctgacgaagtcacaatcggaattgtaaaagagagacttggcaaagatgattgtgaaagaggttttcttctggacggatttccgcgaacagtcgctcaagccgaagctcttgaagaaattcttgaggaatacggcaagccgattgattatgtcattaacattgaagtcgacaaagacgctcttatggaacgtctgactggacgcagaatttgcagtgtttgcggcacaacctatcatttagtctttaatccgccgaaaacgccgggtatttgtgataaagacggaggcgaactctatcaacgggcagatgataatgaggaaacagtctctaaacggcttgaggtaaacatgaagcaaactcagcctttactcgatttctattcagagaaaggttatcttgcaaacgtgaatggccagcaggacattcaagacgtttatgcagatgtgaaggatcttcttggaggattaaaaaaatgattatctgtaaaaccccacgtgaacttggtatcatgcgggaagcagggcgaatcgtggctttaactcatgaagagttaaaaaagcacattaaaccaggaatctcgacaaaagaattggatcaaattgccgaacgttttattaagaagcagggtgcaatcccatcttttaaggggtataatgggtttcgcgggagcatttgcgtatcagttaatgaagaactcgttcacggcatacctggcagcagggtgctgaaggacggtgacatcatcagtattgatatcggtgctaaattaaatggttatcatggtgactctgcatggacatatccggtaggaaacatcagcgatgatgacaaaaaacttctggaagtgacagaggagtctttatataaaggcttgcaggaagcaaaaccaggtgaacgtttgtcgaatatttcccacgcaatacaaacgtatgtcgaaaatgagcagttttcagttgttagggagtatgtcggacatggtgttggtcaagacttgcatgaggacccgcaaattcctcattacggtccgcccaacaaaggaccacggcttaaacctggcatggttctcgctattgaacctatggtgaacgctggcagccgctacgtgaaaacattggctgataactggacggttgtaacggtagatgggaaaaagtgtgctcattttgaacatacgattgcgattacggaaacgggttttgatatactgacgagagtctagatgatgaaaataattccgaagacagatgtttttcaagcttgatagggcagaaagcttgggtgaacattggcaagaccgaattcatcttgctgcttgtcgttggaattttaaccatcatcaatgtactaacagcagacggagaaaagcgtacatttcattctcctaagataaagaatatcaatcatttaaccctttatgattgcgtatctccggaagttcagaacagtataaacgaaacagggcgtgtgacaaacttcttttgaaatttgtcagaaagcaagttactgatttgaagaagggagaacacttgaatggcgaaagacgatgtaattgaagtggaaggtactatagtcgaaacactgccaaacgcgatgttcaaagttgaacttgaaaatggccacactgttttggctcatgtatctggtaaaatccgcatgcacttcattcgcattttacctggagacaaagttacggtagaattatctccatatgacttaactcgtggcaggattacgtaccgttacaaataaagcactccggaaactgaaggaggttggaaacacatgaaagtgagaccatcagttaaaccaatctgcgaaaaatgtaaagttattcgcagaaaaggaaaagtaatggtgatctgtgaaaatccaaagcataaacaaaaacaaggataatttataaggaggtgcccagagaatggctcgtattgctggtgtagatatcccacgtgacaaacgtgttgttatttctttaacatacatcttcggaattggccgcacaacggctcagcaagttttaaaagaagctggagtttcagaagatactcgtgtgcgcgatcttactgaagaagaacttggtaaaatccgtgatattattgacaaactgaaagtagaaggtgaccttcgccgtgaagtttctcttaatatcaaacgtctgatcgaaatcggaagctaccgcggaatccgtcatcgcagaggattacctgttcgcggacaaaactctaaaaacaatgcgcgtactcgtaaaggtccgcgtcgtactgtagctaacaagaaaaaataagtaagggaggttcttaaacaatggctgctgctcgtaaatctaacacgcgtaaacgtcgcgtgaaaaagaatattgagtctggaattgctcatattcgttcaactttcaataacacgatcgttacgatcactgacactcatggtaatgctatttcttggtctagtgccggagctttaggattcagaggttctcgtaaatctactccttttgctgcgcaaatggctgcagaaacagctgctaaaggttcaatcgaacatggtcttaaaactctagaggttactgttaaaggacctggttcaggccgtgaagctgcaatccgtgcacttcaagctgctggactagaagtcactgctatcagagacgtaactcctgttcctcataacggatgccgtccaccaaaacgtcgccgcgtgtaatttgtttgtatagattttgtgtccctgtcaataatgggttatgatacagttatttatgaaacgaatgcaccgactcgttgcctgagcacatacgggactaaacaatggggaatttcggatggaatctcatatgattctattcgaggtttcgacgttttgaaggagggttttaagtaatgatcgagattgaaaaaccaaaaatcgaaacggttgaaatcagcgacgatgccaaatttggtaagtttgtcgtagagccacttgagcgtggatatggtacaactctgggtaactccttacgtcgtatcctcttatcctcactccctggtgccgctgtaacatcaatccagatagatggtgtactgcacgaattctcgacaattgaaggcgttgtggaagatgttacaacgattatcttacacattaaaaagcttgcattgaaaatctactctgatgaagagaagacgctagaaattgatgtacagggtgaaggaactgtaacggcagctgatattacacacgatagtgatgtagagatcttaaatcctgatcttcatatcgcgactcttggtgagaatgcgagtttccgagttcgccttactgctcaaagaggacgtgggtatacgcctgctgacgcaaacaagagagacgatcagccaatcggcgtgattccgatcgattctatctatacgccagtttctcgtgtatcttatcaggtagagaacactcgtgtaggccaagttgcaaactatgataaacttacacttgatgtttggactgatggaagcactggaccgaaagaagcaattgcgcttggttcaaagattttaactgaacaccttaatatattcgttggtttaactgacgaagctcaacatgctgaaatcatggttgaaaaagaagaagatcaaaaagagaaagttcttgaaatgacaattgaagaattggatctttctgttcgttcttacaactgcttaaagcgtgcgggtattaacacggttcaagagcttgcgaacaagacggaagaagatatgatgaaagttcgaaatctaggacgcaaatcacttgaagaagtgaaagcgaaactagaagaacttggactcggacttcgcaaagacgattgactagtttcccttgtgaactaggattttcgtgtgtttattattcagaaacagcattccaataaaggaggggacatcacatgtcatacagaaaactaggacgtacgagtgcacagcgtaaagctatgcttcgtgatcttacaactgatttgatcatcaacgaaagaatcgaaacaactgaaacacgtgcgaaagaacttcgctctgtagttgaaaaaatgatcacgcttggcaaacgcggtgatcttcacgctcgccgtcaagctgctgcatacatccgcaacgaggttgcaaacgaagaaaataaccaagatgcacttcaaaaattattctctgacattgcaactcgttacgaggagcgccaaggcggatacacacgtattatgaagcttggtcctcgccgtggtgacggagcaccaatggcaattatcgaattggtttaatcacatatttttgtgtatctaaagaagggcgggacagtttctaactggatctatgccctttttttagatactgcaacttttaatagagagaaaagcagagcattagctgagaggaggccggttttccatgaatcaaaatcagttgatatcggtagaggatatcgtatttcgatatcggaaggacgcagaaagacgagcactagacggcgtctccctgcaggtgtatgagggtgaatggcttgcaatcgtaggtcataacggttcagggaaatcaacactggcccgggcattgaatggtttaattcttcctgaatcaggcgacattgaggttgccgggattcaattgacagaggaatctgtttgggaagtgcgtaagaagataggtatggtctttcaaaatccggataaccaatttgtcggaacgactgttcgcgatgatgtggcttttggtttagaaaacaatggtgtaccgcgggaagaaatgattgagagagtagactgggcagtaaaacaggtgaatatgcaagattttctcgatcaagagccgcaccatctctccggaggccaaaagcagagagttgcgattgcgggggttattgccgcacgtcctgatattattatcttagatgaagcaacatccatgcttgatccgatcgggcgagaagaagtgcttgaaacggtaagacatttaaaagagcagggcatggcgactgtcatatccattacacatgatctgaatgaggcagcaaaagcagacaggatcattgtcatgaatggcggtaaaaaatatgctgaagggccgcctgaagagatttttaaattgaataaagaacttgttcgaattgggcttgatttacccttctcatttcagcttagccagcttttaagagaaaatggactggctttggaagaaaaccatttgactcaggaagggctggtgaaagagctgtggacattacaatcaaagatgtagagcatcgttatcagatgaagacgccgtttgagcgcctagcactgtatgatatcaatgcatcgattaaagaaggatgctacgtagccgttatcgggcatacaggctctggtaagtccactcttcttcagcacctaaatggtctcctgaagccgacgaagggacagatatcactaggcagcactgtcattcaggcagggaaaaagaataaagaactgaaaaaacttcgtaaaaaagtcggaatcgttttccaatttcctgagcatcaattattcgaagaaacagttcttaaagatatttcattcggaccgatgaactttggtgttaaaaaagaagatgctgaacaaaaagcgagagagatgctgcagcttgtaggtttatcagaagagcttttggacaggtccccctttgaattaagcggggacaaatgcgcagagttgcaattgccggcgtacttgcaatggaccctgaagtgcttgttctggatgaaccgactgcaggattggacccaagagggcgaaaagagattatggacatgttttatgagcttcatcaacgtgggaacctgacgacgatccttgtgacacacagcatggaggatgcagctgcatacgctgatgaaatgattgttatgcataaaggaacgatacaagcatcaggcagtccgcgtgatctgtttttaaagggtgaagagatggccggctgggggctggatcttcctgaaacaataaaattccaaagacaccttgaagctgcactgggtgtgagatttaatgagcctatgctcacaattgaagatgccgctgctgaaatccacgctctttttcagggggagaagactttatgatggacagcatgattatcggcaagtatgtaccgggtacttcacttgtgcaccggcttgaccccagaacaaaactgatcacgatctttttatttgtctgcatcgtattcttagccaataatgttcagacatatgcgttgcttggtttatttacaattggcgtcgtttctttaacaagagttccattctcttttttaatgaaagggctgaagccaattatctggattgtcctttttacgttccttcttcacatccttatgacacatgaaggaccgattatctttcaaataggttttttcaaagtctatgagggcggtctggttcaggggatattcatttctcttagattcgtctatttgattttaatcacaactttattaacgcttacgactacaccgattgagattaccgatggaatggagcagctgctgaacccattgaaaaaattaaagcttcctgttcatgagctggctcttatgatgtcaatttctttacggtttattccgacactgatggaggagacagataagatcatgaaggctcagatggcgcgaggcgttgattttacaagcgggcctgtcaaagaaagagtgaaggctattgtcccgcttcttgtcccgctcttcgtcagcgcatttaaacgcgccgaagagcttgcggtggcaatggaagcaagaggctatcaaggcggagaaggacgtacgaaatatagaaagcttgtatggacaggaaaagacacttctgtcattgtcagcttaattgtattagctgctttgttatttttcttaagggcttagaggtgctgtatgagactgaaatgcacgatttcttatgacggacatttgtttaacggttatcaggttcagccgggcaaaagaacggttcaggatgaactggagaaggctttggctgtcctgcataagtcaaaagacagaattccggtcgtttcgtctggaagaacagacagcggggttcacgcagccggacaggtgattcattttgacactccactgtctatcccggctgagagatggccatatgccttaaatgcactgcttccggacgatatcgcagtcaaacaggcagaaattgcggatgatgggttccatgcacgatttagcgcagtcaaaaaagaatatcgctactttgtatacacggagaaacacccggacgtatttaaacggcattacgcttaccatttttcatatcgccttaatgtgcaggacatgagagaagcggcaaagcatcttatagggacacatgattttacgagcttttgcgcggctaaaacagaagtgcaggacaaggtaagaacgatatacgaacttgattggactgagacggctgacggcctgcaaatgcggatcacaggcagcggtttcttatataatatggtcagaattattgcgggtactttgcttgatgcaggtattggaaaaatttctcccgatgaggtgaaatccatgctggaagcgaaggatcgcgaagcggcagggcgcacagcgccggggcacgggctatatttatggaacgtttactatgacaactaaaccaggtgtataatattttcttgacagagtctgcataaagttataagatatcatatggtatgtatttcaaccccacgataagccccggaacttattgtgttgtgaaatagaacgtaatcgaagtttattgaaaatgacagatcatttaggagggaaattcaatgcgtacaacacctatggctaacgcaagtactattgaacgcaagtggttagttgttgatgctgctggcaagactttaggtcgtctttcttcagaagttgcagctatccttcgcggaaaacacaaaccaacttacacaccacacgttgatactggagatcatgtgatcatcatcaacgctgaaaaaatcgagttaactggtaaaaagttaactgacaaaatctactaccgtcacactcaacatccaggcggattaaaatcaagaactgctcttgaaatgcgtacaaactaccctgagaaaatgcttgagcttgctatcaaaggcatgcttccaaaaggttctctaggtcgtcaaatgttcaaaaaattgaacgtataccgtggttctgagcatccacacgaagcacaaaaacctgaagtttacgaacttcgcggttaattaaaaaggaggttaccaatttggcacaggttcaatattacggtactggccgtcgtaaaagctctgtagcgcgtgtgcgtttagttccaggagaaggccgtatcgtcgttaataatcgtgaaatcagcgaacatatcccatctgcagctttaatcgaagatatcaaacaaccattaactttgactgaaacagctggcacttatgatgttttagtaaacgtacatggaggcggcttatctggtcaagctggagcaatccgtcacggtatcgctcgtgctttgcttgaagcagatccagaataccgtacaactcttaaacgtgcaggtcttctgactcgtgacgctcgtatgaaagaacgtaaaaaatacggtcttaaaggcgctcgtcgtgcacctcagttctcaaaacgttaattttacgttttcaaaaagctctcgaccttgggttgggagcttttttcttttaatataacgtggccagctccgcataaaaataacactgaatggacgcttgacggggttaaacaaattgtttgtttataaacggtctctctgtaaaaatcatgatagctttcatttttattcaattggaagttcggtcaatgtttattatcgttatgtcggcagcccagctccatttaaccactgtatctcatccgttaaagttcactgctgattaactcggagaaacaatagctctcattgctaatggctttatgtaacgaagtaaaagtaaatctgatgatataaatcacatatctcctttgtgatttttttgcgtttttatgaacttttttctaaatatacaaagggaaagcgatatcaatctagaaatatttgttatactctatacattaaagtaaggagaagattcatgaatgcgttagtagctcataatagcaaagcctgggataaaaaagtagaaacaggcaatgaatggactgttgctgctgagcagcaggttatcgaacaagcaaaaaaaggaaattgggatataagggtaacgccaatgaaagatgtaccgaaggattggtttccgccggtcaaaggtctgaaagtactctgtttagcatcaggcggcggccagcaaggtccagttttggcagccgcaggcgcggatgtcaccgtattagataactcagaaaaacagctgaatcaggatagaatggttgctgagcgagatggtctcacgatacacactgtcaaaggaagcatggacgatttaagtgtatttaatgatgaatcatatgatgtcattgtacatcctgttgccaatgtttttgttgagaatgtcctcccggtatggaaggaagcgcaccgtgtgttgaaaaggaacggcattctaatctcgggttttgtcaatcctgttgtatttctgtttgatacagaattagaacagcaaggtgttttaaaagtaaaacactccattccatatgctgacccagaagatcttccgaaacatagagtgaaaaaactgatcgaaaataatgaggctctggaattcggccattccttagaagaccaaatcaaaggccaaattgatgccggttttatcgttactggtttttatgaagataaaggcgggtttgtattagaccaatatatccatacatattctgcaacaagaagcgtgaaagtatgaaaagcagcgacctgttagaggggctgcttttttcataactaattacagaacgtttgttcctgaccctgcagaaagttgattttttatcgattttacaccttcatttgggcgaatttccaaccgaattcgggcattgtttcattatccaaacctcaaaataatcgataaaaggagagtgaatttatatggcagaagtactgtcttttatggatgtgaaacgccaaaaggattttgaattagaaaagaacttgctcaaagaactctctctgagacaaattatccagtctgttaaggattgtttggaaccattgtttccatttttacatgatgaacgagatattattaccgaaggctgtattgattttgctatagaagcctatttgttaggcgggcgttttgggatattcggctattacggagaatccatgcagagtatcagtgcacgctctgcaagagaagaagaagagcttagtatggagttttttgattatctctataattggatacacgagcaatacgcaacatttgataaaaacacggtttatgaagcggcacgcaagttcattaaagattggtggacagcggggtttgttcaaagagaaaaacagtgtaagcttcgcatgcggtaatcatatttcccggccctgtcccatagttatgtaataacggacaagcgggaggggaagggatgaggaaaaagcttaaatggctcagttttttgctaggcttcatcgtattactatttctgttcaaatatcagttcagcaataacgactcttggaagccgtggagcctgcccttgagcggtaaaatcatttatctagatccaggtcatggcgggcctgacggcggagcagtcggcggaaagctgttagagaaggatgttaccctggaagtggcctttagagtcagggattatcttcaagaacaaggagcgcttgttatcatgaccagagaaagtgatactgatctcgctccagaaggaacaaaaggttatagtcgacgaaaagctgaggatctaagacaacgagtcaaattaataaaccattcagaggcggagctctatatcagcattcatcttaatgcgattccgtcacaaaaatggagcggagcccaaagcttttattacgggaaatatgcggaaaatgagaaagtcgcaaaatacatccaagatgagctgagaagaaatctggaaaacacaacccggaaagcaaagcggattcatggtatctacttaatgcaaaacgtcaccaaaccgggggcgcttatagaagtcggatttttatccaatccaaacgaagcaacgctgctcggtaaaccgaaatatcaagacaaggtggcatcttccatatataaaggcattttgcgatatttcacagaaaaaggagaccctccggagtaatggagggttttcttgtggttctaagcataagacacccgccatttatgtatgatataataataattgtaaacgaatacacaaaagggtgaggttcgatgataagagaagatgaagtaagaaaactagtcggagaaatgcgcgaaccttttcttcaaagacctctgggagaattggatgccgttaaggaaattaaaataaagcctgaaaaacggcatatcagtgtaaaagtcgctcttgcaaaaacaggaactgcagaacaaatgcagattcagcaagagatcgtaaacgtattaaaaggggcaggagctgagacagtcggccttcgatttgaagagctgcctgaagaaacggttgctaaattccgggcgccgtcagctgagaaaaaaacattattaaatatggataacccgccagtctttcttgctgtagcaagtggaaaaggcggcgtaggcaagtcaactgtgtcagtaaacctagctatttctctggctcgtctagggaaaaaggttggtttaattgatgcggatatttatgggttcagtgtgccggacatgatgggtatcactgtgcgtccaacaattgaaggagagaaacttcttcctgttgaacgctttggagtaaaggtcatgtcaatgggctttttcgtagaagaaaatgctccggtcgtatggagagggccgatgctcggcaaaatgctgaataactttttccatgaagtagagtggggagaagtagactatattgttcttgatcttccgcctggtacaggggacgttgctctcgatgtacatacaatgcttccgagctgcaaagaaattatcgtatctacgccacatccgacagctgcttttgtcgcggccagagcgggctctatggcgattaaaaccgatcatgaggtcgtgggtgtcatagagaacatggcttattatgaaagtgcaacgacaggggaaagagaatatgtgtttggaaaaggcggaggagataaactggctgaggaactaaacgtgcctttactcggcagaatcccattgaaacagcccgattgggataaggaccaatttgctccgtctgtttatgacgaaaatcatccaatcggagaaatatatcaggacatcgcaaaaaaaatagatgcaaaaatgtcagtgcaggtataaaaggtgaaccgggattccagatcccggctttccctttattcactttctttggccgtgtcttttgctgcttttttcagttcatcttcgaactgttttttgtaaagcggactagaaagtgtttcgttaataacctcttctaaataactgcggaattcttggctttttgccagctggctgtactttttatccatgccgggatcctgcataacgctcatcagcatcttctggtaatctggatccttcatcagctttttaatcactttttcatgctctgtttgaagagttttggcaaagccctcagcaaaatcagtgtcttcaaagatgtttttccaaaattcttcaccttttttagatgtgagtgttttttctattgttcctttaattgcatcttggtcaatcaccagcgcttcattcatggcatcatcatttaataattccttaatagctttctttccatcatcagtttttaatatatcaacaaccatttttttggtctgatcatagtccatatccgctgcttggtcttttggagcgcaagctgttacagataataataaaaaacagctcatcaatagcgttttggcttttgacatgcttaagctcctttcacatacttgtcttacctttaatatgattcatctgtttggaattatacataacaaaatatcgctgttcgcgatttttgaggggtgaataaagaaatgaaaagccgtggtttagttcgttttttcttttctattttagctgtcggggcgcttatcacgagtattgtgggttttgctttaaaatggggagaatatagagggctgtttctgacatttgaagcgggacagattttctctgttttattttggtttatcggtgtaggcatgattttcagtgtgatcagccaaatgggttttttcgtgtttttaacagtccatcggtttgcgcttgagatattaaggtcctcctctttgtggaatttgctgcagttgtttttcatcctgtttgttgcttttgatttaatgtacgtgcgttttttattttttggagagagcggagaatcgctggctgggtatgcgtggttaccggtgtttttattgatctttggagtgattacagcttatataaagcaaaagcagtcctctaagaaaacatttgtgtcatcgttgtttttgatggttgtgattaccgcattagaatggttccctgcattaagagtaaatgatgaggactggctttatttaatgctttttccgttaatggcatgtaatgccttccaattgctgatgctgccgaagtttgcagcaaagtaattactttacctctgcggatttggcatcagaatttgcgatgagatcacccacggttacattttttaatcctttttctttcagctgatggatgatatcgggcaacgcttcttctgtttgttttgccgaatcggaggcatgtaaaagaataatgtctccaccggaaacttgcttggtcacattgtcgatgattttttcaactccaggatttgtccagtcttgcgagttcacactgtaatgaacgactgtataattgtattgctttgcgacctttagaacattcttattgaattggccggtagggggtcttaatagctgtatgtctttgacccctaacttttcaaaggctgtttgagcacggtctatgtccttttttatttcgctgctctctaaattggcatagtttttataagcgtagcccatgctcccaatttgatgtccatcctttacgatacgggccactgtgtcgggatggcgttctgcccaagaagcggacaggaaaaacgttgcgtttttaatcccgtttgctttcagagtattaagtatcggttctgctctctcatcaccccagctgatatcgaaagtaagtgaaatatctttagagtctgtttctcctttataaatggctttaggtccggtgtcagttgaaaacacgggaagcgggacagctctttggatataaaaaaagctggcagctgcaaatgcggcgataagtataataattaattgttttacccgtttaatgtgccacacatagaagtgattcactgatgatgcctccttatcttgtccatcattcttgttttacatcttatgagcatggacaattgaatataaccgataaaatgtctcttcacatacagcctaaattgggtgttgaccttttgataatatccgtgatatattattattcgtcgctgataaacagctgacatcaactaaaagcttcattaagtactttgaaaaaagttgttgacttaaaagaagctaaatgttatagtaataaagctgcttcgttaagcggcggtaatgatctttgaaaactaaacaagacaaaacgtacctgttaattcagtttttaaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttaggggtttccgcccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttaggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggatcagcccaaaccaagaggcttgcctcttggggttgtaggacactctgtacggagttacaaaggagcgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccgggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagcttttcagcgccgatggtagtcggggtttccccctgtgagagtaggacgccgccaagcagatttattaattctaccatgtttgtttatgaagctttatattattccgcagtagctcagtggtagagctatcggctgttaaccgatcggtcgtaggttcgaatcctacctgcggagccattgcttccatagctcagcaggtagagcacttccatggtaaggaagaggtcagcggttcgagcccgcttggaagctttattaaatgtattattaccaaggtttctcataaggagaaagctttttttattgcgatatgcggaagtagttcagtggtagaacaccaccttgccaaggtgggggtcgcgggttcgaatcccgtcttccgctccatttatcccaacgggatattgtaaattgaattgcgcccgtagctcaattggatagagcgtttgactacggatcaaaaggttaggggttcgactcctctcgggcgcgccatatcttttaatagaatagatagggaatcgggaagtagctcagcttggtagagcacatggtttgggaccatggggtcgcaggttcgaatcctgtcttcccgaccatttttatggggccttagctcagctgggagagcgcctgctttgcacgcaggaggtcagcggttcgatcccgctaggctccaccaaaagttttttaaaaaagttgttgactttgaagaagtgacgttgtatactaataaagttgctttaacaaagcggacaaacaaaatgatctttgaaaactaaacaagacaaaacgtacctgttaattcagtttttaaaaatcgcacagcgatgtgcgtagtcagtcaaactagggcctgcacgacgcaggtcacacaggtgtcgccgcagaatgcggtgattttaacctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccgctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtcccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatgggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcggggtttccccctgtgagagtaggacgccgccaagcaattgcacgttagtgtaatttttaaaaaaagttgttgactttgaagaagtgacgttgtatactaataaagttgctttaacaaagcggacaaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttaggggtttccgccccttagtgctgcagctaacgcattaagcactccgcctggggagtacggtcgcaagactgaaactcaaaggaattgacggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggtgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatgggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccgggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttcccctgtgagagtaggacgccgccaagcaagcttaaacccagctcattgagctgggttttttattttatatctgtgccgatttgctttcgttagtatccattttactaatatttttgaatcccaatacaatcaccagcatgatcaacatgagagtcataaataatcaaaatgcaggttgtacgggagactcatccagactccatccgactgcgattggcaggatagagccgccaatccattggcagcgagcagcatgcctgtcgtttgttcggaaaccggctcgggttgccaaatgagagaaaagatattactgtcattaaaacgattcttggtttcatccggatatgataaaatgtctcagactatatttaagccatttttttcttcagcattcatcttgcgtaattgataaaaatttattatgatactctttgtatgacaactccttgcctcaatacaatatactcaacgtttccccgttttccccggtcgtttttcttttcattttctcccgtaaaataaaaaaagctcccaatacaatagatatggtgcggattaattttactaaaaaggagtcgttatatttgaataatagttttacattaaaacagcaatggttcggcaatatccgaaaagacattcttgctggcattttagttgcgttagcattaattcctgaagcgattggcttttctattatagccggtgtggatccgatggtcggtctttatgcgtcattttgtatagccattattatttctatttttggcggcagacctggcatgatttcagctgcgacaggctcaatggcagtcgttatggtgtcgctggttgctgatcatgggcttcagtatttatttgcagctacgattttgacaggtattattcaggtgattttaggtatcagtaaaattgcaagattaatgaaattcatcccgcgttctgtgatgatcgggtttgtgaatgcgctggcgatccttatcttctctgcgcagcttccccagtttgaaggtgcttcttggagcatgtatgcgatgcttgccgggtcgttggttattatttatgtgctgccgagatttacgactgctgttccgtctccgcttgttgctattattgtgatgacaattattgcggtcactttccatgtggatgtgcggacggttggtgatatgggcaatatttctagttcattgcctcatttcttaatccctgatgttccgtttacctttgaaacactgcaaattatttttccttattcaattgctttagcgtttgtcgggttgcttgaatctttgctgacagcgcagattattgatgaaatgacggatacggacagtgataaaaataaagagagccgcggacagggaattgcgaatatcgtgactggattctttggcggaatggcaggctgcgctatgatcggacaatctgtcattaatacaaaagcgggcggtcgcggacgtttgtcagcatttgttgccggtgcttttctgatgtttttaattgcggtgttaagtcatgtcgtggtgaaaatcccaatggcggcgttagtagctgtaatggttatggtgtctgtcggcacttttgattggtcttccttaaaaggtctcaaaaaagcgccgctcacggactcgattgtcatggttgtgactgtggttacggttgttgtgacggatgacttatctaagggtgtatttgtcggtgttcttttaagtgccgtgttctttgtagcaaaaatctcgaagctgaaaatcgtttctcatgcagaggatcaaaagcttagaacgtatcaagtgaaggggcaaatcttttttgcgtcagtgactgatcttacgaatgcgtttatatatcaagaggatattgagcgggttgtgattgacttaactgaagctcacgtatgggacgattctggtgtggccgcacttgataagattgttgcgaagtttaaggaacaaggcattgaagctgagttaaaaggtttgaataaagcgagtaaatctctaatgaaacggatggcataaaatagagaagcccagatgaatgagatctgggcttttttatataacatacacttaagcagcattgatataatagagagaagagaaattttaaataggggacttgcatatgatgcttcagaagctgaaccgtgtattggggagggttatgccgctgttaacgccgactagtgtggtgctgggcgtgctgctgtctcagtttttaaatgggtatgaatgggctgtgccttggatctttgcttttattacgtttgcaggcagtttaagcgcgaactttcaatctttgagacatgcattgtctcaccctctccctatgattcttgcactattcgttcttcatattttcatgccgctttttgcttggggcagcggccatcttatatttaaaggtgatcctttgacgattaccggtttaacattggctgttgtgattcctacggggattacaagcttgatttgggcagcgatgtacaaagggaatgtcggtttgacactttcgattattttaattgatactgtgctgtcaccgctaatcgtaccgctgagtctttcattgctggccggcgctcaggttcatatggatgtgtggggaatgatgaaaggtctgattgtaatggtcgtgattccttcttttctgggcatgctgtttaatcagatgtcatctccagaaagaacttcgtctttgagcagtgcgctgtcgcctttttcaaagctttgcttgatggcagtgattgcgattaacagttcagccattgctccttatttcaaatccattgatttgagatttgcaggaatagctgtaacggtattctttatcgcgttaacaggttatgccgctgcttggctgatcggaaaaatgatgaaaaggcggcaagaggaaatagtctctcttatatttacgggaggcatgaggaatattagtgccggcgcagttcttgccgttacgttcttcccgtctcaggttgccgttcctgttgtgattggcatgctgtttcagcagatattggctgctttgtttggctatatgctgaatcgttttgaattaaaaccaatgttgcagaaagtataaaaaaccgctcatagggttgagcggttttttccgtatagccattcgagcgcgttgatgaactgtttgcagaaatacttgcggtggtgcaccgctcctttttcaattgaaagatacaactggtcttcagtgaagcctttttcttttagactttgatgaacttgctttgtttttttaagcatatgtcgctgaatggattgtttttcacggccttcttcactcccgacagacatgaaaacacgtacagtgccgggctttaaagaagttatatgaatggtttccgctgcgttctcgtaccagtatgaacctgatatagagcctattttcccgaacattgacggatattttaatatggcgaacattgagatgaggccgcctaatgaggcaccgatcattcctcttgactgcggttccctggtgacgttccagttttcttcgattagcggaatgaactggttcgttatatcagacagatagtgatatcccattccgccgaagtccgtgaaccgatcactgagtgatgcagccggccaaggtgtgtattcatttagccggttttcgggttcgataccgatcagcacgagtttaggcagccttcgctgttgaaatgcgttttctaataattcgatttggttttggaacaaagaactgccatcctgcacgtaaacagcaggaaatcccccgctgtctgtgctgtaggaaggagggaggtacagcgtgaacctcctgttgccggctttgtgttctgaaagagatcctttcaagcattctcccctttttttgcttgaaaagcagatataagaaataaggaactccgaggatcgccaaaatgatgcctgcgggcacttctgcgggctgaaaaaacagttttccggcaaagtctgcgcttatcacaagaagcatcccgattaaaccgctcagtggcaggatatagcgatgttcgacgccagccagtctccgtgagatatggggagcaattaagccgacaaacgccatgcttcccgctacggagacacaggcgctgatgattgctacacaggctacgagcaggatggttttttctttatttgatgaaatgccgaggcttctgactgtgtcttcatcaaaacgaatggtgtcgagcaggcgggatttgccgataagaatcggtataaacagcagcatccatgggagaacggctgtgatatacgtccagttggcagaccagatgcttccgtttttccacaccatggccatttgatagtcttgcgggtccatttttaaagataaaaacaaagacagggcgctgaatcctgaattgatcgcaatccctaccagaataattcttcctgaatctaaattgcctctgtgccatgcaaatatgtaaatcaggatcgccgcgatgagcccgcctatcaatccaaagagcggcattcccatcgctgcagctatggatgtcacttccttctggccttggaataagagcataaacgctacaatgccggctcctgcccctgcgttgattccgagaattccagggtcagcaagcccgtttctcgtgatggcctggataacagcgcctgcaatgccaagaccgagtccaataatagcagccatgacaacccgcggcagtcttaaatcgaacaacaaaatttcatactgcggattcgggtcgatttgaaaaagagtggagagcagctcagcaggacgaacagaaaatgatccgctcgttaagctgaaataactgacaaccagaatcaaagcgatgaacaatgcatattttttagccattttgctcccctccttttcgtttaattaaataaaggaagaaaggtacgccgataatggatgttacgacctcaatcggtgtttcaaacggatagttgataaatctgcttgcgagatcacacagggttaaaaagattccgcccaaaatacaggagcacggaatcagcctgctgtaatcagagccgacgagaaatctcgtgatatgcggaacaaccaacccgacaaacgcaatttttccggccagcgctacggcactgccggttagaatgatgacggaaagcatcgccatgattttaatggtttttttcttttgccccaggcttttagaaatgtcgtcccctaatgatacagcggttacctttttgctgagagaaatggccattataatgccaatcaggaaaaacggagcggcaagcttcaggaaatctggactcatttgatgaagtctggcactgtaccagaaactgagatcctgagaaatttgaaaataaatcgacatggccgctgataagctgctgagcagcatgcttgtgactgtgccgatgatggcgagctgcacgggggtaaatccgtttggcatcatggcggcaaggccgaatactaacacagctcctaacgctgagccgataaaagagtatatcatcatttcaattgaagatgattgcgggagcagaaccatgcaaagcgtaatgataaacgctgaaccatctgaaacacccataatggatggcgaagctaaataattgcgcgtaatgccctgcataagcgctccagaaacagcaagggctgcccctatgagcagagcgccggcagcccttggaatccgggagtgccatataatttgatggtctgtgtttcccggatcgaaatgaataagagatgtaaaaacaatatctgtgctaagatgctttgccccataaaggattgaaagcaaaagcgacagcgttatagcaaatggagaagtaatcaatatgatacgtgtccactgttttgaatacatacaaaaacctactctgaattagttttgtgtcaatttttcagcagccgctttcaggaaacggactttgctccaagctgtgccgccttgtgcgagagggtccactgagttgacatacacatggtcttctttgactgctttaaggcttttccagattggatttttctctaaatcttttaaggcatcaggtttgtctgcattttcatcatcagaaaattggacgaaaatatggtctgggttcatttcacttaatttttctaatgaaatcagctcttgcgcttttgcagcttttacttcattcggcgccttaaggcctaaatcaccatatagtgtggagttgaaatacacctgttcagggtaaatgtaaatattgccttgtctgattctgatgacaagcgcttttgaatctttcgctttatcattgatttttgtttttgtttcatttagatcctgttcatagtctgcaataattttcttagcttttttctcttttccagtcagctgggcaagcagcatcatgttttccttccagtttgaagagatatgagaaactgggatcgtcgtgcctgctgtgctgattttttgcagcgttttttccggaaactttgttgaagctaggataacatctggcttcatttcaagaatcttttcaatatttggctccattttttctccggttggttcggctttatcagtgatgtctttgaacatatcagggaatttgccggagaatgaaattgcgccttgcggatgaacgtcaagcaatttcgcgtcttccattgattcaacgcttcccgtaatggcgattttgtctgtcggtacagttacttcatatgttttatcaaggtattcaattttctttttctcagatgctgtgccgcttgccttgctggcagttgattcatttttgctgccgcaagctgccgctgtcagcgcgagaagcaagattaataaggtaagagatatatttttcatctatagagccccctgttcaattgataactattatcaattggaattatagagaatgaacagatataacaccatggacaaattcctgatttatcatggataatctccggatagtaaagaaacagtttgctgaacgatgcgttcgtgcccgcaagctgagtattcattccacggatcaagggatagaagataaacacggttattctgtaccgcgcttaggttttgccatgcttctgtctgctgtaattgctggtagtaagctatggtctccggctctttaaaaagaaaaagcatcatacagtcagcttggtaatttgcgatattttctaacgaaatcgcttgttctgaaggtgtgtcagccgttgttgccgagctgaatcctaaatccccaaagaaaacttcgcggacgcttcggttatgtgccagatagaagttttgcttatgcagcctcaaaaagagaaaacgcagcccttgaacgtgctgaagcgtttttttggcggctgttgtctgctggtcataatccgctagccacttttctgcttcggactcctcctttaaaaatgaggcagtttgcagaaagtgggttctccagctttcttctgaaggaaggtacatgacttctgcgatgcgattcaggcgatcttgttcttctggagaaatagaatccatgctgacaatcacatctggttctgcctgtgataacgtgtacaggttttcttcccacttttcattaaaccggtatgcactgagctggacgggtatatctgtcgaataatgctgatagtagtaagacgtccatttcggatgcagagcggccgcaaaaggtatgtggtgaagagggatgagatggcccattgtgccccttccgtatgcggcgattttctttcggcgttttttcatatagcttgtaggtgaacagcctgtatgttttttaaagattctgctgaaataaaattcatcttgataaccggtttggtgtgcaatttctttcaatttgcagtttgattttgccatgagccgttttgcctttgtgattcgtgttttcgtaataaattctgttacgctctgtcctgtccattttttaaagctttcactgtagtgtttggcactgattcctgccatttgcgacagctgggcaagcgtgatttttgtatcggcatgggtttcgatatagtgttttgttttttcgattgctgaatgtgtatccgtttgatcagataaactggcagtaaaaaggtcataaatcaggctttgtacttcaattacacattttagctgagaaagctgagacgattcattccatagtgcggcaagctcttgaagccggacggcaagattttcgatatgtgaaacattcataagcttcagtttggctaattccgattctgtgcacggtgtgaaaatatcttgcccggtttccttgatatagctttgaagcctgatcatacaggcatctatatgtccatcggctgccggcgtaaagccaaaggtctcgttaggcggacaaacataaagtgtctttttttgcagaggattggtgtttgttccgatcgaaatatagccgtttccttttaaatgaaaaatcagcacgaatgaatcggctaattgctgttctgagaagagatcacttgtcttttttagatattcaatttgtatcggttgataaatcactgcattttgcacgagtagaccaccttttcagaggcttttaattgataatcattttcaataaaaattgtaccaaataaaagaaagttttcctatataaagcgggtggttttttagtatgaaaaaaacccttacttatgtgtaaaagtaagggtctttcgttcggtaagaatatgttacacgtgtaacatacgatgcttacgttctaataaatgagatatttttttcttgttttgctgaattgttggagtgttttttcatagctgtttatgatgttctcaatcgaagttccatttttaatttttgtcctgatccagccgttgcctgccagtttatcgaatgaacctgttgacaggaactcaaaatcctcaggatagagatcgtgtatggttttaatgactgaaagacccgttttaacggcttcaaacttatctctgtctgtcacatagagctgcacaccgtggcaaagcgttccttgatgtttagaaaacgtcggtgtgaaggatgctgccctaaatgtaacgcccggcaaatggaggctgtttaatgtttcttcaagttctgtgcttttgataaagggagctccgatcaattcgaatggctttgttgtccctcgcccttcggatatatttgttccttcaatcagcccggttgcaggataaacaaatgtgctttccaccgtcggcatgttaggcgaagggaggacgaaaggcaatcgggtatcgtcaaaatccatttttcgcttccagtgtttcatttttaccactgtaagatcggcattaatactaaattctttgttgaacagtaaagccaattcgcctatcgtcatcccatgcttcaatggaatgggatacaatccgacaaatgaggcgtattcaggttctaagattggtccttcaatatgattcccgccttgaggattcggacggtccagcaccataaatggaatgccgttttctttagcggcttccattgcgtatgccattgtataaatgtacgtgtagaaacgggtcccgacatcctgaatgtcaaacattagaatatcgacatttttcagcatttctggagtcggttttttcgtttttccgtagaggctgtatacgggtaccccggttttttcgtcaatgtaagagcctacttcgtctccagcctgggcgtcaccgcggacgccgtgttcagggccgaataaagctgtcagtttgatatctgggttctcgtaaagaatatcgacactgcttttcagagatgcgtttactccggttggattggtgatcagtccgatgcgttttcccttgagctgttttttatagtctggcaagagcgtgtctataccagtctggactttaggctttttagccgtttgattctttgaatcgggtgaagcagaggcagcggttatcgttccgaacatcatgagccctgtcagaaaagcgaatattgtttttctcatgtgtccctccttattaaagcggtcttcccgttttgatatttaatccgtagccaaatgggtaaagggtgttccctggtttcgtgactgacggaatgtcaactggaagtgtgcctttaggttttgcctggccgaatatcgccatcactccggccggaatattaggttgaagataacggccatttgcgtatcctttaaagccatagactgcaatcagtgcctttgcttcttcgaaattggctgcgtcataggggttgcgcaggctcattaagacaaagggtttgttgtgctgcagtgcggctttcatgacagctctcggaaacacggtggcccatttgcttgaatctgatattgtgtcgtcgatgacaccgtcgttgacgacagggtcatttttgacgacataggagccggttatgatataatcagccttttttacttgttttgcatgctcggcattaaatatttggttggcaaaatttattttgtcgacagatacgggtttgattttctttcgcttgatgagatcgtgaatggtttgttcgattgaagcagtttgttcttcgtaaggtgccacaattaagatgtggctgccttttttaggcttgaacggcaaagtgtgctgttcattttttaatacagttactgctttttcagctatttttttctctgctttcaggtgctgcttgcttcctacgattttttgggctttggctattttttcttttgtactgtcgctgtttcgcgctggatacatgccgcgttttattttcagggaaatgattctttcaactgatttgttgatttgttgttcaggaatatccccgtttttcacggcttctttcaaagcttgaataacacgtgcgaatttctgttcttctttcattgaagtgactgaggctggcattaatgcaatatcgacaccagcttttacggccatgaccacagcctcttcctgtccgaaatgatctgcgattgccttcatattgagtgcatcggtaacgatcacaccattaaagcccatttcctgacgaagaagacctgtcatcactttttttgaaagtgtagctggaaccagaatgtccgatccatcgagtttgcttttgtatatggtgtcgtcgaaggcagggaattgaacatgggctgtcatcaccatatcagcaccagcatcaattgctttttgaaaaggataaagctcgacttcacgaagccgttcttggccatgggaaacgagcggcagtccataatggctgtcaacgtccgtgtctccatgtcccgggaaatgtttgagggcagacgcgatatcctgccgctgcaaccctttcatcgtgtataaaccgaggcgtgatgtcagttctcgattggagctgaatgaccgtacgccgattacaggattattaggattattgttaatgtccacgacagggctgaaatctgtattgatgcctaaggcagagagctctttcccgatgatgctgccggtctgatacgcattgattctgcttctggctgcgcccagcgccatattccctgggaaattagtgccctcccctaacctcgttacaatgccgccttcctgatcaatactcagcatgagcgggatttttggacttgccttttggtaatcgtctgtcagttggacagtttgttttgttgtttttacattttctgcaaaaaggatgatgcctccgaattgatatttcttgacgaggctggcgacttcatcattcatttctgtaagggcttgcggagaggactcgccttccttttgccagtttctaaaatcaggcatcagcatctggccgagtttttcatctaacgacatacgattgacaatctgattggcatcgattgcacgtttggatgcagaggcttctgtctgtctggccccgaaaaagcatgaaataaagagaacggctgaaaggataagcggaaagacaggtctcatagaaacttcctcctatcgtctaatcattcactccatcgcttcataaatcgcggttatgacacttccataactgcttgttgcaaattgatcaccctcaaagacgtttggattttcttccggatcaataactggcgtatgctttttatttgttaacaatgcgatgcctaaattgtatgctggatcaataattgtaactgtccccgtccagccggtatgcccgtaagcattttcgctggcatgagggccaaacatccattccatgcttttacttccgttccgcctccagccaagagcgaatgtcggatctgttgctgaaggtgctgtaaacaggtcggctgttttctgatcaaataaagaaatgtttcggtatgaacctttgtttaacatgacttgcagcagtatggccatatcatctgcatttgagaacaatccggcatgcccagacacgccgtccattgagtaaaacgctttttcgtcatgcacctctccttgcagcgtgtttgtacggatgttagggaattgaataacgccgtcacgtgtattgcccatgcgttcagtagctgcgaactgtttcggtttaaagcccttttccagcggattgtacaaggtatgcttcagcctgagcggtttgtagagctcttgctccgtgtagacatcaagcggttgaccggtgagtttttcgacaatacatccgagtagcatatatccaatgtcactgtatacgtgctttgtcctagtttggtaatcgagcggaattttcgtcaaatattcaatcgttttgtcccgttcctgggaatagtacttgccggctttttcaggcgtgtaaaagtaaaagcttgatgggagccctgattggtgctgaaggacatcgatgacacgtatcttgtcttttccttttatgaggtctccaggctgatccctgaaacccggcaaatatgcagaaactttttcatagacgtcaagttttccttggctgactaagcgctgcaatgcaaaatttgttgcgtacatttttgtattcgaggctaagtcaaacatcgttctggttttcattttggctggacggcgcagcagttctgacccttcgtactttttactgtagccgtatgctgctttttttataatgcgtccatccttcaccaccacaagaacggcgcctggaaatcctgctgcaatatcccgttctatcatctgatctaccttccttagcttcttcgtcgagaattgtgcagtttctgcatttatggttttcgactcaatcaagttgtctgctgtttgtgcgaaggtttcatttggcgcaaatatcgatagggttaaaatggcactgaatatgaacagtgtctttgttttcacaggctagcccctttctgtgcttctatcccgtttactatccctaatacagaaacaatttaatcgaactgagaagccatttcatctttatatccgaatgcataggtcaataaaaagccggccgcgtaggaaataaagagcccaacgatatacaggatgatttgcgaaggcaggactagaaaggaaagcggcagtccggagacaccaatcgcaatggtggctacttgaaaataagcttgaaaggcgccgccgattccagctcctaaacatgctgttaaaaacggacggccaagcggcagcgtgactccgaaaataagcggttcaccaatgccgagcagtcccgatggaagcccgccggcgattgctttcctcagtgttgtttttttcgtcttcacgaaaacggcaaaggccgcgcctacctgtcctgcacctcccatagccaaaatagggagcagaggatcattgccaattgaattgatcagttccatgtgcacaggcgtcaagccttgatgcagtccggttacgacgagaggaaggaaggttgcgcccagaataaagcccgcagcgatgccgccgatgtccaggatggacagtaggccggatgtaagagcatcagaaatgaatccgcctaaaggcataaatacgacatacgttacgattccggtgattaacagtgaaacggtgggtgtgacaatgatatcgagtgattgaggaataaaacggcgaataaattgttcggtgtaagcaatgaatatggctgcgaaaaggacgccgatcagacctcccctgcccgggagaagctcttctccaaataaactgatttttgcgatctccggattgataatcaagatcccggctaaagccccaagtgcgggtgtcccgccaaattctttcgaagcgttaataccgacgagaatgccgagataagtgaacagccctgatccgatgactgtcaggataaccgcaatttgtgagtctgcagagagccagcctgcttgaataattgctttggtaatcccagtaattaaaccggaagcgactagagcgggaataagagggataaaaatgctggcaattttacgtaagaaaagtttaaaaggagtggcgttttttcgattgatatcggctttctttttggccgctgcttctttgacatcggcactttcttctgctgacacgagctttgagaaagcagctgtaacatgattgacgactcctgtgccgaggataatttgtaaggtttcagcttcaacgacccccaatacgccgtcaagctttcttaaaccctgagcatctgctttgctttcatcgtaaggcgtaatgcgcaggcgtgtcatgcaatgcgtatatgaagaaatattggattttcctccgcatagctcaaggattttctgtgcgagatgatggtagttattttctttgctcattaaaacccctccccttcaagatgccttatttttttctcatagattggatggctgctctcgttttatcgatataaccggttgtcgtttcatactgctcagccgccatgcctaaaaacaaaacatcaattataaaaagctgggcgaggcgggaggaagtggccgcacttcgaatcaaggcttcattggaatgggctgtatacaaagggacatcagccagtgcggagacggatgtctgactgaattgtgtgatgctgatcgttgtaatgcctttttccttagccatggcgaacagttcaacgatttcttgtgtctctcctgaaaacgaaatggcgaatacgatgtcgtctttatctgcatttgcgattaaagatgccacaagatgagtgtctgtaaacgcggttgcttgtttatgaatgcgaagccacttttgctgggcgtccttggcgacaatgccggaagccccgaggccgataaaatgcacggtatgagctttgagaagcagagaaaccgctcgttcaagctctttgtagtccatcatgtctgaagtatcctgaatggcttgaatggcattgccggccgttttttcggaaatggagggcagcggctcgtggggaacaatatcccggtagccctgaaacgtaggctttgccagatcgcctgctactctcatttttaaatcttgaaatccttttaaaccgagtgatttgcagagcctgatgacggcagcgtcacttgaattggctaaggcgctgatttcgttgaccgtgctttcgattgctttgtggggatgggctaggatataatctgcaagtttgcgctcggatggagggagcttatgcttcattgattggatgatcgctaaaccgcctgtggccattctagttctctccttatcatggatggtaatgttcgattgctttgtcaatgaaaccgtttgcttcatcgagtaatgtctttgcttgtttctgatctgtgcttgttttgagcatgacgattgctgttttgacgtgatgatcggcttgttccagagtgtatcttgctgtgtcgtatgaagcgtttgtaaggctttggatgatgctgatggcgcgttcttttagttttttgttgctgacgttgacgtctaccatcaagttttcgtaaaccttgccgattttgaccattacagcggtagatatcatgtttagaatcattttatgagcggttgcggctttcatacgtgttgatcctgtaatggcctcaggtccgacgacaacctcaatgctgtgatccgcatccttgctgatggcggagttttcattgcaagtaagggcgatggtgtgtgctccgacttttcgggcgtatcttagggcgcctgcggcgtacggtgtgcggccgcttgctgcgatggcaatgacggtgtcatttgaagtgagctgtatgtttcttaaatcttcagctcctgcttcttcactgtcttcaatgccctctgctgcctgtaaaaaggctttggggcctccagccatgattccgatgacctgatcagggcttacgctgtaggtgggaggacattcaacagcatccatgacgccgattctgccgcttgtgccggcgcctgtatatatgagccggcctccattttgaaacgattcatatgcgcagtctacagctgttttgatgtcggggagaacctcctgaacggctgcagcgactttcatatcttcgttgttgatcattttgagaatgccaagagtgtttgctttgtggatttcaactgtttggctattgcgtgattccgttgtgagacggtgaaggtttaatggttctgacatgaggatgccccctgttttaaaatgatatatctcaatattcagtatattcatttctgttatgatatttcaactatgtttttaaatttttgaaattttatttcacttaagactataagaaatgatgaaggatcaactgttctccaagcggcccgattcttcgccgtcctttatcaaggaacccgcttttcatataaaggtgttttgcgcgtatgttcagatgattgacggctaagatgatttcgtcgcaccatggaaaatatccgctcacaaaagcgggaagcaaaagcatggcttttttcgcatagccttttctgtgatgcacagcgtttaaagacagggagctgagcagtaaagcaaatggattgttagaataggaagcaagcgtttcttttgatgcatgtaaaatgaaaaaaccgactggaaggtcgtcttttaagatgacaaccgggtatcggtcctgtatgcccagagcttgagacagcacctctttcgggagggaggtaaagcgtttgtcatcgttggtgagcgtgaatgattgaagctcgggcaagtgttcaggcttatagaaggataaagaaatgtcttgagtcatgtggtggcctccttacaatatgtcgtcaagctcgttttccgaaatgacgcggtagcccgcttgttttaacagtgcggcggttactccgctgccggtgatttttttgccagagaatgtgccgttatagataaaaccgcttccgcaagatggactgttttcttttaatatgacggcagaagcgttgatttcttttgcgtaagccaatgttttcgcggcgccttccatatatagttctgtgacttcttctcctgaagctgtcacgattttcgctgttccattgaggacatcctcgccggtgcctcctatgatttctgcgggttcgcgtggggtagagaagccgccgagaagttcagggcaagccatgactgctttcttttcatcgacgagttttctgattttctccgacgctgcgtgagagccgttatatctgcattcaatgcctccaaggcaagaactgactagaatcatattaggttctcctctcttgctttgcttgtctctatcataaaataaatggctttagttgggaggctttttcagttaaaaaaggagttaaaaagtttgaaaataaaaaatttaatttttctctttacaaacagggggtgacctgtatataataacttttgtcagctcgacgagaacacaacggcccgttggtcaagcggttaagacaccgccctttcacggcggtaacacgggttcgaatcccgtacgggtcaccatttggaggattagctcagctgggagagcatctgccttacaagcagagggtcggcggttcgagcccgtcatcctccaccatcttgccggtgtagctcaattggtagagcaactgacttgtaatcagtaggttgggggttcaagtcctcttgccggcactgttttttcaaaattttatgtggaggggtagcgaagtggctaaacgcggcggactgtaaatccgctccctcagggttcggcagttcgaatctgcccccctccaccattattgggctatagccaagcggtaaggcaacggactttgactccgtcatgcgttggttcgaatccagctagcccagtcacagacacctttgatcaaaaggtgtcttttttcttttcggaaaaatcattccaacttctaactgttcagtctgtataataattttaaaaatatgttaaggtagtttattcacgaattaccatctacaccctgccaaaaatttgataaacttattttataaaaaaattgaaaccttttgaaacgaagctcgtatacatacagaccggtgaaggcagaggttagataaatatggaaatgatgattaaaaaaagaattaaacaagtcaaaaaaggcgaccaggatgcatttgcggacatcgtagatatttacaaagataaaatttatcagctttgctaccgtatgcttggcaatgtgcatgaggcggaggatattgcacaggaagctttcatcagagcgtacgttaatatcgacagttttgatattaaccggaaattttcaacttggctttatcgaatcgcgaccaatttgaccattgaccgcattcgcaaaaagaagccggattattacctcgatgcagaggtggctggtacggaaggcttgaccatgtattctcaaatcgccgcagatggtgttttgcctgaagatgcagttgtgtcgctggagctctcaaacacgatacagcagaaaattttaaagcttcctgacaaatacagaacagtcatcgtattaaagtatattgacgaactctcattaattgaaatcggggagattctaaacattcctgtggggactgtgaaaacgcggattcacagaggcagagaggctcttagaaaacaattaagggatctttaagtggggtgatgaaatgagctgtcctgaacaaattgtgcagcttatgcatatgcatcttgatggagatatccttccaaaagatgaacacgtattaaatgaacatctggagacatgcgagaaatgcagaaagcatttttacgagatggagaaatccatagcgctcgtacggagcacttcgcatgtcgaagcccccgcggattttaccgctaatgtcatggcaaaattgcctaaggagaagaaaagagcttctgtaaaaagatggttcagaacccatcccgttatcgcagctgctgcggtattcatcattttgatgggcgggggttttttaacagctggcataatgaccacaatttcagcgtgtccaagcagccgaatcttgtggttcataaccatactgtgaccgtgccagaaggtgagacggtcaaaggtgatgtcactgtcaaaaacggcaagctgattattaaaggcaaaatagacggggatgtaaccgtcgtaaacggcgaaaagtatatggcctctgctggacaagtcaccggtcagattgaagaaatcaatcaattattcgactggacatggtacaagatgaagtctgcggggaaaagtgtactcgatgcattcaatccgaacggagaagagtaaagcgcgttagccgctttgctctttttttgcgggctgagagggctggcacatttcacttgctaaatcgaaatgtggtataatgggctcgctatgtaaagtacatatgcgtaacacgtaaaacacaaaatacgaaatgactgaaatcttggaggacgaggaaatggcttttgaggatatcccttttttgcagtacctcggcaatgccgttgatattctccttgtttggtatgtgatatataaattgattatggtgatacgcggcacgaaagcggttcagctgttaaaaggaattgtagtcatcgtgcttgttcgtatggccagccaatatttgggcctcagcacacttcaatggctgatggaccaagcgataacatggggatttttagcaattattattatttttcagcctgagctgagaagagcgcttgaacagctaggccgcggccgctttttttcgaggagcggcacgcctgttgaagaagcgcagcagaaaacgattgaggccattacaaaagcgatcaattatatggcgaaacgccgtataggcgccctgctgaccattgagcgggatactggaatgggggattatattgagactggcataccactgaatgccaaagtcagctctgagctgctgatcaatatttttatcccaaacaccccgcttcatgacggtgcggtgattatgaaaaataatgaaattgccgcggccgcctgttatctgccgctttctgagagcccgtttatttcaaaagaactgggcacgcggcacagagcagctgtcggtatcagtgaagtaacagacagtttgacgattattgtgtctgaagagaccggcggcgtcagtgtggcaaagaacggcgaccttcacagagagctgacagaagaagcgctgaaagaaatgcttgaagccgagtttaagaaaaacaccagagacacttcttctaaccgctggtattggaggggcaagaaaaatggataaattcttaaacaaccgctgggctgtgaaaatcattgctctgcttttcgcgctcttgctttatgtggcggttaacagcaaccaagcaccgactccgaaaaaaccgggtgaatctttctttccgacatcaacaactgatgaagcaactctgactgatattccggttaaagcgtattatgatgatgaaaattacgtcgtgacgggtgttccgcaaacggttaatgtcacgataaaaggctcgacaagcgccgtgaaaaaggctcggcagaccaaaaactttgaaatatatgctgatatggaacatttgaaaaccggcacacataaggttgagcttaaggccaaaaacgtgtcggatgggctgacaatctcaattaatccgtctgttacgacagtgaccattcaggaacggacgaccaaaagttttcccgtagaagtggagtactacaacaaaagcaagatgaaaaaaggctattctccggagcagccgattgtcagtccgaaaaatgtgcagattaccggatcgaaaaatgtcatcgataatatttctcttgtaaaagcttcagtgaatttggaaaacgcagatgaaacgattgaaaaggaagcgaaagtgactgtctatgataaagacggaaacgcgcttcctgtcgacgtggagccctcggtcatcaagattaccgttccggtgacaagcccgagtaaaaaagtgccatttaaaattgaacggacaggaagccttcctgacggtgtcagcatagcgaatattgaatccagccccagtgaggtaacggtttacggctcacaggatgtgttggattctcttgaatttattgacggcgtcagcttagatttaagtaaaattaacaaggattccgatatcgaggcagatattccgcttcctgacggtgtcaaaaaaatctcaccgtcaaaggtgactttgcatatagaagtcgatagtgaagcggatcagaagttcgagaatgtccctatcaagactgtagggctgagcagctcacaaaacattgaatttcttgatcctgaatcacaagcgatagatgtaacggctaaaggctctcccacgaatataaaaaaactgaaaaaatcagatattgaattgtatgtgaatgtttcagatttagaggacggggagcatagcgtgaagcttgaagtgaacgggccacagaatgtaacctggtccttggggcggaaaaacgccaaaatcaagctgacgtccaagaaaagcaatacatcaacgaatgataacagcagcaatacatcagggaaccagggtgacacagataaacaaacaaatgatcaaaagaacaatcagcaagaagatacaaagaacactgataaaaacagcaacgatcaaaaccaagacgaaaataaagatcaaaaccaagatcaggatgaggatgaatccactgcgaattcacaatcctcatcggaataaaaaaggagcgattataaaatgggcaagtattttggaacagacggtgtaagaggtgtcgccaatagtgagcttacacctgagctggcctttaaagtcggacgtttcggcggttatgtgctgacaaaagacaaacaacgtccaaaagtgctgataggccgcgatacacgcatctccggccatatgctggagggagcccttgtcgccggacttttatccattggcgcagaagtcatgcgtctgggtgtcatttctacaccaggtgtatcttatttgacaaaagcgatggatgcagaggcgggcgtcatgatttccgcttctcataacccagtgcaggataacggcatcaaattctttggggagatggatttaagctttctgatgaacaggaggctgaaattgagcgcctgatggacgaacctgaggataagctgccaagacctgtcggagcagaccttggacttgtaaacgattattttgaaggcggacaaaaatatctgcagttcttaaaacagacagctgatgaagatttcacaggcattcatgtggcattggactgtgcccatggcgcaacgtcatccttggcgacacacctgtttgctgatttagatgcagatgtttctacaatggggacttccccgaacggattaaacattaatgacggcgtcggttcgactcatcccgaagcgctcagcgcgtttgtcaaagagaaaaacgcggatctcggtcttgcgttcgacggtgacggcgaccgcctgattgctgtcgatgaaaaaggaaatattgtagacggcgaccaaatcatgtacatatgctcaaaacatctgaaatcagagggccgtttaaaggatgatacagtggtttcaaccgtgatgagcaacctcggcttctataaggcgctcgaaaaagaaggcatcaaaagcgtacagacagctgtcggcgaccgctacgtagtagaagcaatgaaaaaagacggctacaacgtcggcggagagcagtcaggacatcttattttccttgattacaacacgacaggggacggattattgtctgctattatgctgatgaacactttgaaagccacaggcaagccgctgtcagagcttgcagctgaaatgcagaagttcccgcagctgttagtcaatgtgagagtgactgataaatataaagttgaagaaaatgaaaaagtaaaagcagttatttctggagttgaaaaagaaatgaacggcgacggccggattttggtgcgcccttcaggaactgaaccgctcgtccgtgtcatggctgaagcgaagacgaaagagctgtgcgatgagtatgtcaatcgcattgttgaagtcgtccggtcagaaatgggattagagtaacgaagtctattatcagagagtgaacaagacaagcgaggtttacataagataattgtgagacatacggcaaagttgtttaaaaaacaattgaccgtttatgccacatgttgtaaaatcaagcttgtcttgttcttattttctcaataggaaaagaagacgggattattgctttacctataattatagcgcccgaactaagcgcccggaaaaaggcttagttgacgaggatggaggttatcgaattttcggcggatgcctcccggctgagtatgcagatcacagccgtaaggatttcttcaaaccaagggggtgactccttgaacaaagagaaatcacatgatcttccaaaaaacatgtaggaggggacgattgaaagtccccttgaaatttgactttcttcgtctccttttacaatcttaggaggaagaaaaatatgtgtggaatcgtaggttatatcggtcagcttgatgcgaaggaaattttattaaaagggttagaaaagcttgagtatcgcggttatgactctgctggtattgctgttgccaacgaacagggaatccatgtgttcaaagaaaaaggacgcattgcagatcttcgtgaagttgtggatgccaatgtagaagcgaaagccggaattgggcatactcgctgggctacacacggcgaaccaagctatctgaacgctcacccgcatcaaagcgcactgggccgctttacacttgttcataacggcgtgatcgagaactatgttcagctgaagcaagagtatttgcaagatgtagagctcaaaagtgacaccgatacagaagtagtcgttcaagtaatcgagcaattcgtcaatggaggacttgagacagaagaagcgttccgcaaaacacttacactgttaaaaggctcttatgcaattgctttattcgataacgacaacagagaaacgatttttgtagcgaaaaacaaaagccctctattagtaggtcttggagatacattcaacgtcgtagcatctgatgcgatggcgatgcttcaagtaaccaacgaatatgttgagctgatggataaagaaatggttatcgtcactgatgaccaagttgtcatcaaaaaccttgatggtgacgtgattacacgtgcgtcttatattgctgagcttgatgccagtgatatcgaaaaaggcacgtaccctcactacatgttgaaagaaacggatgagcagcctgttgttatgcgcaaaatcatccaaacgtatcaagatgaaaacggcaagctgtctgtgcctggcgatatcgctgccgctgtagcggaagcggaccgcatctatatcattggctgcggaaccagctaccatgcaggacttgtcggtaaacaatatattgaaatgtgggcaaacgtgccggttgaagtgcatgtagcgagtgaattctcctacaacatgccgcttctgtctaagaaaccgctcttcattttcctttctcaaagcggagaaacagcagacagccgcgcggttctcgttcaagtcaaagcgcttggacacaaagccctgacaatcacaaacgtacctggatcaacgctttctcgtgaagctgactatacattgctgcttcatgcaggccctgagatcgctgttgcgtcaacgaaagcatacactgcacaaatcgcagttcttgcggttcttgcttctgtagctgctgacaaaaacggcatcgatatcggatttgaccttgtcaaagaactcggtatcgctgcaaacgcaatggaagctctatgcgaccagaaagacgaaatggaaatgatcgctcgtgaatacctgactgtatccagaaatgctttcttcatcggacgcggccttgactacttcgtatgtgtcgaaggcgcactgaagctgaaagagatttcttacatccaggcagaaggctttgccggcggagagctgaagcacggaacgattgccttgatcgaacaaggaacaccagtattcgcactggcaactcaagagcacgtaaacctaagcatccgcggaaacgtcaaagaagttgccgctcgcggagcaaacacatgcatcatctcactgaaaggcctagacgatgcggatgacagattcgtactgccggaagtaaacccagcgcttgctccgttggtatctgttgttccattgcagctgatcgcttactatgctgcactgcatcgcggctgtgatgttgataaaccgcgtaaccttgcgaagagtgttactgtggagtaataaatgtttaacccctttggataagattatctaaaggggtgtttttatgtccaaaagagaaagaacgtctacagtggaaaaatggattaaagaagttgatggtacaggacccgactatcgatcggccatagctatagatttaagatgtttccacataaggtcggtcaatcaggttaaaaggcattaagacttttgcctaactgagttttctgatgttaatacagatataagagagcagttcctcattaagatacgcttttgatagcagttggaatttagcatgctagaaatccgaaaaccggagagcctattggaatgataacgtttttttttattgtcaattaataaaggcaaagaattctagaagtcgcacttacaatgtacttgtaggccttaggttttaaagctcattctttttttattgagtacattccggtttaagttgaaatgattcagtaaaggacacgccataaataaaaggtagcgtatgactcccatgttttccatgaaaacgatatttctaagatttcatctttcgtaggctttcgattcatattacgtaatatttttatcgaacgaattagacccacatcatcgatcggaaaagctgtcgggaacctaaggcagcgcattagaacataattggctgtccaaggaccgattcctcgtattttaattaagtttttttcagcatctttaaagttcattttcattaatttttccctcgataattccccacttgccattaatctggctattccaatgatatattcacttttttttaccgtcattttaatatctgccaggtcggtaggggttaaccgtgcaattcgctcgtacggtgggaacacccaatactttttaccattccattcaatagtatcgccaaatgcttctacaaattgcttctttaaggagtacgcgaaggctaagttaatttgttgccctaaaactccccaacataaagcttcaaataaatcgggaatgccgatcactcgcaacccataaaattttcgggcaggcattttaagtaatggatctgcttttgccatttcataaaatggagttaaatcgttatcaagatcaaaccattcatgaatatattttacaatctcttcccgtttccactgctcaacaggtctagaatcgtttaggaattgaacaatcatttgtttattattgattacgcttacctgcactaaggaccgaatttccccaatggctataacttttgtaatgatattgttctctatttcatacatgcattcatttttttccctggttaggtagccaaggttagcattcatgtcgaaaatttcaggtaatgtaatgacaataatatcattgacttcatgccatgccactttttctttctccttatcttaaataattataagaagactcacgctggttgaaattagtttatcacataatcatctttactcattttgttatcttgctattacattctaaccatcttatttttttctatttatgaggttatagtgtagttatcaagaatgttaaacgggagtagataaaaatggcccaagatataaaaatcgcgtgtcgaaaatttaaattgggatttaattcaaaatgaattagatgagccatgtaaggacaggtgagataaatgccggataatatcaataacggacataaagagagccatgatcatagaattttgaatgatgcagaaataataacagatgaaaagtggcaagcaattataaataatgatgcaacgtataataatcaatttttctacgctgtaaagtcgacaggggtattctgtaaaccatcctgtaaatctcgtgttccgaaaaaagaaaatgtatgtatttttccaaacgcagaacaagctctccgcgcaaattttcgcccttgtaaacgttgcaagcccactaatgaaaaaatgcctgatcgcgagtgggttgatttaattactgaatatattgataaaaatttctcagaaaaattaacgctagaatcgttagcagatatttgtcatgggagtccgtatcatctgcatcgaacatttaaaaaattaaaggcattacactggttgagtatatacaacaagttagagtacacgcggctaaaaagtatttgattcagacaaataaatcgattggagatatcgctatatgtgtgggtatagctaacgcgccttattttataactttatttaaaaagaaaactggacagacaccagcacaatttcgtcaaatgagtaaaatggaggaaacgtacaatggaaacaaataaaccaaccctttatttgtctttactaatgttcaaggagtggaatttttatattgcttcaactttaaaggggcttgtgtttgtaggttcacagaacaaaccaatcgaggaattgttcgaatgggctaggaaacgctttccgggaagtcttcttgttgaagatgatgataagcttgaaccctatgccgttgaaatcactcaatatctagaaggaaagcggaaaaactttactgttccagttgagtacgccggtacgcaatttcagctagcagtctggaatgcactttgtgaaattccttatggacagacgaaatcctattccgacattgcaaatgaaataaataaaccagcagctgttcgtgctgtaggtgcggctattggggctaatccggtattaattactgtaccgtgccatcgtgtaataggaaagaatggctcattaactggctatcggggcggattcgaaatgaagacactgctcctcgatctggaaaagcgagcttcatctgaaatggatgttcctcattgaaagtgaatcatctataatagggtggattcttttagaggaaagtaaagaccagtttactgataaacttgacaactttaaaaatttagcatatcttatacgtaacttaataatcgatacagatgtttatttttccttttaaaatatgtaggcctttagcattcttttcatatttaattttaaatattgataggatgaaaaagtatcctaataaaaaaggaagagaacatgagtcgatttatttgataatcaggactatattaaaggaaatgaaaacatagcataaagtaaagaccaataataaggtagcacttcaaaaaacttcgctgaagttagttgaagtgaagccgacaattttcaggattcaatgatctaacataatcattgaaattttgaagttgtcggcttttttgttggaaaaaaatagagataaataaaaattgaaataaataatagacaaatatgatctgtttgaaaggtcttttgaacaataatgagttttcaaaaagggagaatttagaatgttagtttcgctgagtttatcttcattattaacattattttttattatgcttatggcttctgggataagtggactattgtttttacatccgcgagtacccttgagttttgttcgcattcatattgggatcttggctttaccacttttggtttccttactgattcttgccaatagtggtgtgagtggaaatgttggcccttggcacttagattccttagcttgtttaatgactttctttgttcttgcaattggattcatcattcagcgtttttctgtacgttacttaatgggggatcgatcttatcgaaaatattttacgctttttactttcacaacaggtgctgcttcaatgacatggttaagtggcgatctccgcttgatggttctattttggggagcaactcttgttggtttaaccttacttattaggttaaacagtgcttggcaagtggctagtgaaacagccaaggtttctggccgcttatttttgttaagttggttttctctgtttttcgcaatgatgtggctttttcatgccacaggtcaatggcagttatcattggttgtaacaaatgaaagtttagctgggctgggagaatgggagagaacagggattcagctattgattgtactggcggtgatcattcctgcagctcaatggccattccaaagatggttggttgagtctattgttgctccaacccctgtttctgcaattatgcatgcaggtttagtaaatgctggaggaataatactaactcgattttcacctctatttcatggtggtatcgcttcgattatcttacttctgcttgctggcatttctgtattgattggaactggaattagtttagtccaggttgattataaacgccagttagtaggctccacgattggacaaatggggtttatgctcattcagtgtgcattaggcgcctatatagcagccattattcatcttattttacatggtttattcaaggctacgttgtttctacaagctggttcagcagtagggcgtcatgaagtatcggctcgtactaatgaaagaacatcctatttatgggtcatggctggtcggattttatccttagttataggtgttgctttttggctcactgctcctggagagggatatcaattcattagtgcactgatcttagggtggtcattgtccgtttcttggactcagcttgtcgcttttggagagggccgaattggccgaattgccggcttaactgttttaggaggagcagccctcgtatattttatcattcataaccttttctataagtggctgcatacaaccatttttcaaagtgttcaacctccaatgtcagctgtcatgattgtcgtatgtctcttactctttggcagtgctttaggtacgtgggttgctcgtcatcgttcttccgtttttttcgcggtactctatctttggttagtccgattaggtgaagcaaaaccaaagtcagtagagagtcacccagactaccttaaacaatatatttcataaggagctaatctgagatgggcattacatccgtattaacgaaagataatgtaaaaaagatagatacagatattgatgttcaagaaagggatcttaacgttttcattacatctgccagccgagtgattgcgccactttggcctatttctacatttgctgcacgtaatccgtggatgggacttgaaaaccaaccttttgatcaggttgcaagttggttgaaaaacactcgcgatgttgatatataccctagtgcgtctatgatccgttcagcaaagaataaaggtgagattgatgaagattttgtggaaatggggctgcagcgttggcttggttcacattcctatcacatcccacgggacgtagcagagcgattttgtcatgctgcattaaagttagatcccctgccttccgaccttttatcatcacatgagctggagaaattagtaggtgaatgtagtggattggatcatatcgagaatgtgtttatgcagccactaagttcgtatatagagaatcaagatggtgaaaggctagtcaatatactagatcatcatgtcattaagtggagtaaattatatcttgatgactctcaagcaggctggacaatgcctaatcgtgaggaaggtttctatcgtgcttggcagcatctcattcaatatgatccagcacttagcaaaaagcagcgagaaagggtaaaggattggccgaaagaggcacatttggctttacaggaagccttattcgcactagaaatcccagagtcagaaatccagacttatcttgaaggtcatttactttcattacctggatgggcagggatgatgctttggcgctcccagcaatcgagccacgaacatgcactcctaacagaatatttagcggttcgaatatccatggagtgggctcttataaagccatacttacctttgactaatgaacgatctaagaaaaaaatttcaattgctccccttatagcagcttggattcattggggtgggcttacattagaagaatggtcacagatgacggccattgaacaaaacgaatatttatcatttgcctacagctttgatgagaaacttcgcaagaaactttggttagaagcttgggagcaaacgtacactgatcgattaagccagaagatcatctcgaaacaacgtgaaaccggcggtaaaaaatctgcattagctcaaatagcattctgcatcgatgtacgatcagaaccttttcgtcgtcaactagaaaaagaaggcccgtttgaaacgattggtattgctggtttcttcggggtgccgattgcaacttgtgaacttggcagtaaacacagtcatgcttccttaccgatcatacaaaaaccgcaaaataaaataaaagagttcgcagatgaggatgtattcaaaaaatacaatcaacggaagcaagcaattcattctttaagccatacctttaaaacgatgaagcagaatgcgctttcgagcttactactgcctgagctaagtggaccttggcttactctgcaaatggcagcccgtagctttgtgccaagaaaggcggggcgtttcattcgtaatctccgtgaggcttggttgcgcaaacctgatacaaaactctcgcttcatcatgatactacagaggcagaaatacctgtgggttttactgatgaagaaaaagtgaactatgctcgccaagcattaaaaatgatggggttaacagaaaacatcgcacccttggtcgtgatctgcgggcatggcagtcaaagcactaataatccttattccgcagcccttgattgtggtgcctgcggtggagcggccggtggattcaatgctagagttttagctgctttatgtaatctatcagaggtacgagaagctcttttagctgaaggaattcaaattcctgaggatacggtttttgcagcagctgaacataatacaacagtagatgaattacattggctttatgtaccagagctttccgaagctgcacaagaagcatttgatcaaattgaagccgtgatgccgaaagtgagacatcatgtaaacaaagaacgtctagcccaattaccgaatttccaatcgaagctaaaaaatccgaaggctgaggcaaaccgatttgcggaagattggagtgagatacgtccggaatggggactggctcgtaatgccgcttttattatcggtaaacgtgaactaactcaggattgtgatttggaaggcagagcctttctccataattatgattggaagcaggatgaaagcggtgaactcctagcaaatattattgcaggacctggaactgtagcccaatggattaatttacaatattacgcatcaacggtagcacctcattattatggtagcggaaataaagcaactcaaaccgttactgcaggtctcggcgttatgcaggggaatgcaagcgatttgttagccggactgccttggcaatccgtcatggaatcagatcacgaggcctatcattctcctcttcgtttattgatactcatccaagcacctagagaatatgtagaacggttattaaataatgattcagcatttctgcaaaaagttcaaaatggatgggtccgactggctagtcttgatccagaaggatgttgggaaagctggtaatgatgaatctaagcatttatcaaatggatttgttactcaatacaaaaatgataaacataaggaagaggtgtgctgtatgaatgtaaaccaaaataaaaaagtattatttttgacggatattgaaaacggtttggagcctattttacaagaagcgactaacacttctgcagagaatatgttgactatacaaagctatggtgccggtatttcacatccttatggagaaatcatgaggtctgttatttttgcgatttaccaggaaggtgttgaggagatttttgtagtaggaacaaaagataagaagacttccgcaggtaatggactaactcaacttgaaacaatgaaagataaaatacaaacattggattatctctttcaaaattgcaagcctgaattttttggtggtacggtcgatgaatggctaaatgaaaatagcagtgacaccattgaaaaaagtgttgatatgattcgacatcatccactagtgccgtcatatgttaaagttagaggtttattcgttcatcataaggatggaaaaccctcaattatggagggtcctgatgctaaaacaggtcaagccatacctgatcattgcttgtcatgatgaaattcaggttcaacttctaaacaccatatatggagaaagcagttctaaggagattgtatgagcgctaatttaactgattttgtcacgaaaacaatagaggacatgaactcgtttgatcgtgaaaatatggaatgtatgaaaaaactaattagaaaagcaattgatttttatcatcttaaatcttatgaagaagttgaggaaacccattcaggaaatgttcgatttttgcatgtccactctatgatggaagaaaatatgttatccaaaatgatagtggtcacaagaaacggtaaaactgatttggatattgaaggtgtatatgaaggatatgttgtaagagaatattaatgagacgaaatcacaaatagaatatgccaatttttttgctcaggagatgtattagatatgaaaaagtcgaagggttctattgaatcagagatcagtaagtccattactcaatgggagaaggattatcttggacgggggtctgtatctgttaagactgatatactgcgggacatgatcatcgtcaatttaaaagggattttaacaccagccgaatatgtagtttgtggatcaaaagagggtatgttatctatcaaacaaactcgttcggagttagtcgaatcaggtatagaaggccttaaggatattatcctaaaaataaccggagaaaaagtgaaaagttttcatactgatttaagctcccggacaggtgaacgagtgatggtgtttaaattatgtaatgatctagagaaaaatttggaaaagatcttataatctaaagaaaataaatgttttgacggtatggaatttgttgtgaattgaacataaagaaatgccgattcttttgttttacaattatggcatcattgataacttttattcatatcctaagcggacataaagagatgtcaattcatagtatactgtcttgttattcctgtcgaaagatctaacatccgctgttgttatgagcggatgtttttttacatctattttaaatacatgaatttgatgctggtgattagtcacttgaacaatatttgaaaaaatccttgtcacctgccgggttccccaagtgtttagtgacacgattatgagaccaatttcgtaaagcttgatgataaatttaagcggtgaacaaaattgatatgctgtcttcagtttcatttcacggaattagctttaattaaatatatccaaaaaacggattgacatatcgaaatataacgatataataatcgatatggaaccaattgaagtattcaaagccttatcaaatgaatcaaggctgcaaattttgcaatggctgaaggaaccggatcgtcattttgcaccccatgaagggattgatatgaacacaatcggggtatgtgttagtcaaatcacagacaaattaaaaatgacgcaatcgacggcttcccaatatcttaccatccttttaagagccggcctaattaaggcggagcgaatcggaaagtacacgtattacaaaagagatgaagaagccattgggaaacttgctgactttcttaaaacagagatataaaaataaacatcaaaagatgtttatttttacaccatacatatcgacatattacgatgtgtttattttttataataacatatcgataattcgtgatatgtttattaataattgaggagtgaatgttttatgtctaacacttggaaaatttatattttagccattgtcagctttttagttggaacctcagagtacatcatttcgggaattttggatcaaattgctcatactctcgggatcactttagctgccgcgggccagctcattaccattttctcacttgtatatgctctgtctacacccgtacttatggcgttgacagcaagtatggatagacgcaaattgatgatgtatgccctaggtttgtttgtgttcggtaatgtcctggcttttgtactgcctggttatggatggtttattgcagcgcggatcattatggcgatgggagcaggtgtggttgttgtcaccgcattaacgattgccgctaagattgcatcggaagggaagcagggcagtgccatcgctacggtcgtgatgggatttaccgcttctttaatcataggtgttccgcttggaagaatgatagcagtagcattaggctggaagtctgtatttggtgccattgctttgttgggattgatcgcgatggtcgttattttctttactcttccgcatactgaagggataagcctgtgcctttgcttcaacagcttgctcttttcaaaaaacggaaagtggctatgggattgtcaatcactttcttctggctcggggatattctgttgcttacacttatttgtcaccgtatctcttgaacatctcaggtataaatggcaagctgctcagcggtgttttgcttatatttggaattgccagtttggttggatcgaagtttggggatatagcaccgataaatggggagtgtcctttacactcgttggcgggatgacgttgcatatcgtcacactgattcttctgtcacttgttactcattcctatatcggagtgttggtgattctcatattatggtcgtttgccgcatggtccaccggtccgacacagcaatttcacctggctacaatagaaccggaaatgtcaggagttttgcttagcatgaatcagtcaatgatgcaattcgccatggcggtcggcgcaggtataggaggggtttttgtggaaaacgtatcattggcctcgattacctgggttggtgcgttaggggttatgattgccattattgcatcattgctgattttcaattcgcaaccgaaacaagcgctaaaagatatcaatcaataatttcgaaagatctaacatccgctcgttatacaagcgggtgtttttttaaaaagctcaagtagaaggcacactgaagctgaaagggatttttgccgacggagagctgaagcacagcaagttataatatactaggaagggaaataacggtatggcggaagggttctagcgcttctcgcctgtaagatcattactttgaggatgtgtcatcgtgaatcaaaagacgtacattgaaatgagcaggacatcgcagtacatcaacaaaatgagagagtattcagtgctaattgatggggctgagatgggaactatcaaagatggaggaaggctgcgaattgatttaccgcctggtgagcatgttattcaagtgaagattgcttggtgtacaagcccaactttgaggtttactttagcggaaggagaagtgttgaagtttagatgcggaagtccgcttcgaggttggaagttgcttttggcacttttttctgttttggcccgtcctgaaaattatctgtttatcgagcaggaagaagagaaaaaagctttgtggtgactttgtgtgaaagaataccgctgaattacgttttgtatttaagtggaagctctctccttggaaggctgagataagagattctcgtctattctttttctttctcctataaaatttatataatagggagaaagaaatggggtgaacagcatatgtttaaaaaaatcatcaaaacgattaagtacctctcaagcagttctagtgaccgatatcgcagacaccggcattacagcagcagccggcgcagacattatcacagctacagcagcagttcgggcaaaagaagacactacgaccgttatggcggcagtcatcgttacaaacgccggagctacagcagcagttaatccaaaaaaagttcttgttccgcttttgggacaagggtttttttatgtgaccgattgaatggcccggtttagatcctcgcgaatggaagcggtgtgctgatactcttcctcaatgcccaataatcttttcagcagcaaggttacttcctttgtcagtgttaattcctccagccaagtgccgtttttcttcttttttcctttatattgagagtacagcaggaataacagcgtttctccgagatcgaagaagtcatcctgttttcgtacctttatttcctccatttcttcaggagtcaattgtttggcaaggccgaaatcgatgaggcagagcctgccgtcattgatgatgatattaggcgttctgatgtcgctgtggaagataaggcgatcatgcaggtattctataatctcaagcagctgcgaaatcagttgtaatgccataagctctgtgaacggctgttttcgaaaaaataataattcttctatattctctccctcaatgaactgcatgacataataagcctgtccgtctatgatgaactcatctatgaagcccggaatttgcgggtggtgaatgctattgagcagttttatttcctgctggaaccggactttttctttttcctttttcgcttttgtcggccgaagctgttttaagacataaggtgtttgagttaggatatcggtgcacaaataaaccaaaccgtagcctcccataccgaggcactcttcgattttgtattgatgatttaagataacgccgttctttagagggcggtcaaatagcagtttttttagaagttttaatgccatgtctgcacttcccttggttgtactgactatagtttaccttctagccggagaataaaaaagagccggataaccggctcggtataagttaaaactgctttgttacgtcgtattcataatctatttttgctttaacattgctcatcgtcgatctggcagtcgctaatgtattatatttaaaactccatacctttgccacactgagttgatctgacaaagagatatcataagaccctgaagtcgagctgtttacaagagcacggcgccattcgttgttttcgctcgtcatgatcaggtggcgtgtatttccctggcttggtgtttgagtggcggttgtctgaactctggttacaatggcatcacgcggtatcccggattggtttgttaaatcaaccttgatcacgctggaatcagaacctgaggggctaaggcttgtatttcctttattttcagcaacgccgctgaattggaatgttccgctgcctgatttgattcggtcttcaattgaaagtgtaaaatacatgtttccggtataggtgcctcgtgacactttcacataaaaggtatctgtcgtgttttgggcgtctgcatttgaataaataaaagaagaaaacgtattagggttaatgacttctgtcccttgagaaacaggtattctattcttatcataaatttcaattttcatccctgtatacgcgctctggtatgtactcctcacgtatactttttctcccttattagccgtaaaagtgaaataggcttcatcttgaccagcttccagtattgttgtatcgatatttttatatttccaataaccgatcggcattgcggtatcaaatgaattgtttcctgtgatagcagtgactccgacagctgatgccgaatacgtaaaggtgaataagacagacagaataacagcgaatggaataagccattttttcaccatgcaaacaacctccttttatttccatcatacataataacgatttaggtgtaaataaatgttttttgaggttaatatatacattatctttgccgataaaaaagaataagagagaatactcgggagggaattcaatgcgtctgaatcggcaatttatccgcactcagctgatggcacagaacatattgagcaagaatgcgcctgccaaacgggagaatgcgactgaaaatccagcggcagttctggaaaaggcatacagcaggcttaagtcacaatcttcaactgggggaatcaatcagttcaattattctaaaaccagcgtgtcgggaaacagcgggacgttcagcaaagtgtatcaatcagcgaatgatcgaacagtgacagacacaggggaagaaacagtgattcaatgccaaaacccctatgaatctgagagtgatatcagaatcaaaatactagatgaaaaatacagcaggatgaatgcgattaacaaaacaaagtctgatcccttaggctatattaaggataagtaccaaaattcaaagtctccttatttcagaagtgatctgtcagctgcagaaagacaggccgcttacgataatgaaacagaatggctattcaaaggcaaggcccaaaactataaccttcaggatgctgcgtttcggaatgtcacatttcatggggaagtggaagctgagaatgaaaaggtgtatcagcggggacaggttaaccagcagctgcaagtgctgttgaatcgaaaccatattcatattccagaggggacagagctgacgtttacaatcacaccgattgactatcaggtgcgggtaagcgggtcagacgatcaggcactgattaagcagattgagcaagtaatgcaatctggggacaacagcaaagagctatttttgcacatcatgaaaagccaaatcagtgattcaacacaattttccgaagaggcctatcaaaagtatcaggctgctcgtgagatgtatgaagttacaggctaccatttgaaggatttagaagtgattgatgggcggtatgtcacgcctgatggacgtgacttattagacgtctataaagaagaacttgaaaaagatccagtgcagaaacaaacggcttcttatgctatatcttactatcgttcagagctcagtaaaatcgcggaagccgggtataatgccattccggatttcatcctatcaattgattacagcaatggatctctgagagatgtgggacaaagcaagagctatgggaccggagataccgggtggcttgaagcattaaagcgtcaaacgggtgtgaattattaggtaagctgttcatgtagaacagcttattttttatgagaatctaagggggtattaatttcaatattcaaacaattttattatttttatataaaagattttaaaagaagtgaacgattcaaaactctgaacaaaggtgtttacctgaaaaaaacaattgtattttccagagaaatttattatgatgaaataagtaattaaggagattatataacaattttaagtttgaattttctgattgttatcactgattcatgtgaaggcaagcaggtctgctgttttctcatttatgagtattttgttaggaggaggaagaggagtggcaaataaagaattaaagaggggcctgggtgcgcgccatattcagatgatcgccttgggcggtacgatcggtgttggcttgtttatgggttctgccagcacgatttcatggactggtccatctgtccttctggcttatgcaatatgcggaatttttatcttttttattatgcgtgcgatgggtgaaatgctgtatgtcgagccgagcacaggttcttttgcgacgttcggccatcaatatattcatccgatggcaggttatataacagcatggagcaactggttccagtggattatcgtcggcatgtcagaaattatcgctgtcggttcttatatgaagtattggttcccggatttgcctgcttggatacctggtatcgtggcaatggtgattcttggtgcggcgaatttaatttctgttaagtcgtttggggaatttgagttttggtttgcgatgattaaaatcgtgacgattatcttgatgattattgcgggaatcggaattattttcttcggttttggaaacggcggagatgcgatcggtttgtcgaacttgtggtctcacgggggcttctttgcaggaggtttctcaggtttcttctttgcactgtctcttgttattgcggcctatcaaggagttgagctgatcggaattacagcgggtgaagcgaaggacccgcaaaacacgctaagaagtgcgattcaaagtattatctggcgtattttgattttctacattggtgctatttttgtgatcgtgacggtgtatccttgggatgagctcaactcactcggaagtccgtttgtgtctacgttctcgaaaatcggaattacggcagcggccggcattattaactttgtcgtgattactgctgcaatgtccggctgtaacagcggtattttcagcgcgggccgcatgctgtatacactgggtgtcaatggacaagcaccgaaattctttaagaagatttcacgcaatggtgtgccgctgtatggcacaattgcggtgctgatcggtttggctgtcggtgttgtactgaactatatcgcgccgccgaagatctttgtctatgtatacagcgcaagcgtgctcccagggatgattccttggtttatcattttgatcagccatatcggattcagaaaagcgaagggtgctgcattagataaacatccattcaaaatgccgtttgctccttttactaactatttgacgattgctttcttgctgatggttctggttggcatgtggtttaacgatgatactcgtatctctctgattgtaggcgtaattttcttagcgcttgtggtcattagttattatgtgtttgggattggcaaacgcacgcaggccaatttgacaaaaagcgaacaagcagctgaataacgataaaaaagagacattcacggatgtctctttttttatttttcgcgtatggattttccctattttagcaagctatagggtaaagatagcagaaggaaaggtgttcatgaaatggatgttacactcggttatttgcgcgaatcactctcgaatcatctagaaaatgaagtctgccagcgtatttgcaagaagatgctggcgaagcgttatgcaaatgaagaggaatttgtaaaagacttagatgataatgaaatgtcttttttgaaccatgtattagaaaaagaaattaagtatgcccagaatgaacaggatcaaaaacgggccaaggaattaaacgaggtgtatgaattactgctttgagaaaggcgggtaagaaatgggagcaattgaacgaagcggatatacatttcagccggagtttagcgttgtccgtcaaaacggagccatccatgtgtaccatcaagtagagtttgtggaagaaatcgaatttgaatttaacggggaatatcccgatcatgatttgattgaagagcttgtgaatcattattgttttgagcatgagatttagagccctgccgtgcagggctcttttatttaggatgtgatcaggccatactttttcaggatatccacggtgatgtttttggcttttgtgccggaatcatcgacattggtgacaaagacataagagccatgctctgttttgatgaatccgacaaaccatcctaatcccatatcagtcaggcgagttccggttttcccgtagagcgtgaaatgatcgccttcctcttgaatcatcatgcgcttgacgattttcatcaccggcttgtcaaatggaagctcctctttagccagtttctccaaaaaagtttcttgttccagcggagatattgtgagcgagctttgcagccaaaactggtcgattccccgctgatatcctcgttgccgtaagatagtgtatgaagccatgatttcatcctttcctcgccgatatctctcgctaattcctgataataccagattgcggattcgcgcatggccgagccaagcgtatggtcgcggttccatgattcgaattcacgcttgaccccgtcccatcgtttaacatcgtattcatctcttacagctttgacctgcaaaccgattaaagcgttcacgactttaaaggtggattgcggagtttgtctttgatttgcccgttttctgttatagacaaatgtctgctccttttgtaaatcgtgaagaatgaaggttccatccgtatccttgaattcatcatcgacattcattctgctgacattcaagtgtttttcatgagcagatgacgctgcgtggacggagaagccgccgatccctgcaatactcagcacaagcacaacatatatccattttttcattttgttctcccctttgttttgattaactaccttttctctctttcgtttgttcttcctttaaaaaataatcaaaaagcgcttaaatttggttttgcaaacaaatactgttactgggtttatagtcggaagataacgtgaaaatagagggtaaaaaggaaggcagggtaagcggatgaatgagcagattccacatgacaaaagtctcgataacagtctgacactgctgaaggaagggtatttatttattaaaaacagaacagagcgctacaattcagatctgtttcaggcccgtttgttgggaaaaaactttatttgcatgactggcgctgaggcggcgaaggtgttttatgatacggatcgattccagcggcagaacgctttgcctaagcgggtgcagaaatcgctgtttggtgttaatgcgattcagggaatggatggcagcgcgcatatccatcggaagatgctttttctgtcattgatgacaccgccgcatcaaaaacgtttggctgagttgatgacagaggagtggaaagcagcagtcacaagatgggagaaggcagatgaggttgtgttatttgaggaagcaaaagaaatcctgtgccgggtagcgtgctattgggcaggtgttccgttgaaggaaacggaagtcaaagagagagcggatgacttcattgacatggtcgacgcgttcggtgctgtgggaccgcggcattggaaaggaagaagagcaaggccgcgtgcggaagagtggattgaagtcatgattgaagatgctcgtgccggcttgctgaaaacgactcccggaacagcgctgcatgaaatggcttttcacacacaagaagatggaagccagctggattcccgcatggcagccattgagctgattaatgtattgcggcctattgtcgccatttcttactttctggtgttttcagctttggcgcttcatgagcatccgaagtataaggaatggctgcggtctggaaacagccgggaaagagaaatgtttgtgcaggaggtccgcagatattatccgttcggcccgtttttaggggcgcttgtcaaaaaagattttgtatggagtaactgtgagtttaagaagggcacatcggtgctgcttgatgtatatggaacgaatcacgaccctcgtctatgggatcatcccgatgaattccggccggaacgatttgctgagcgggaagaaaatccgtttgatatgattcctcaaggcggggggcacgccgaaaaaggccaccgctgtccaggggaaggcattacaattgaagtcatgaaagcgagcctggatttcctcgtccatcagattgaatacgatgttccggaacaatcactgcattacagtctcgccagaatgccgtcattgcctgaaagcggcttcgtaatgagcggaatcagacgaaaaagttaaatcaaaaagctctcttcctttatcgaagagagctttttgattacttctttttttcatcgtagtattggacgggatacatggagccttctgataccattttgttatcctcgatatcttgcgggtccgggtggccggctttatcaactgggaacgtttccatatcgggctgttttgttattttcatcttcatgctgtgaatgaattctcttgccttttggcgatttgacgggtcttttaatagataagaagtgatgccgacagttgaaacagcgagacctgaaagtaacagcttttgtttcatggtgatactcctttctattttaagaatagtgtttcctgtatcattcccgttttggaaatagctaaacctattgtttttttatcgttgggattaacagcaaattccatttaagaagaaactagtgacttcattcctgtattggaaggtaatatacattgacttattatagtttcagtcaaaattcgataaatattgacaaagtaaagtaatcagaataataatataattagcaagagaatgtcatcatacatgaaaggtgtttacgatatgaatcaattgcatcgaagaatgggaacgttttccctcatgatggtcgggctagggtcgatgatcggttcaggctggctgttcggggcttggcgtgcggctcaaatagcaggaccagctgctattatttcatgggttattggaatggtcgtcattttatttattgctctttcttatagtgaactaggttctatgttccctgaagcggggggaatggtcaaatacacgcaatattcacacggttcgtttatcggttttattgcgggctgggccaactggattgcgattgtgtccgtcattccggttgaagcggtggcctccgttcaatatatgagttcttggccttgggaatgggcgaaatggacaagcggtttggtgaagaatggaacgctgactggggaaggactagcgtttgcctctgtattgcttctcatttattttctgctgaactactggacagtcaatctattttcgaaagcgaattcattaattacgatttttaaaattattattccgggtcttacgattggagctttgctgtttgtcggattccacggagaaaactttactggcggtcaaagcattgcgccgaatggctgggcaagtgtgctgacggcggttgccacttcaggtatcgtttttgcgtttaatggtttccaaagcccgattaatatggcgggtgaagcaaaaaatccggggaaatcaatcccgattgcggttgttggctctcttttcgttgcgacagtgatttatgtcctgctgcagatcgccttcattggagctgtgaatccttctgatattgctcacggctggagccatctgaattttaattctccttttgctgatctggcgattgcgctgaatattaactggctagttattgtgttatatgcggatgcatttgtatcaccgtctggaacagggattacgtatacggcgacaacgtcccgaatgatttacggaatggaaaaaaacaaatacatgccgagtatattcgggaagcttcatccgatttacggcgttccgcgacaagcaatgttctttaacttgattgtgtcgttcatctttttgttcctgttcagagggtggggcgtattagcggaaattatttccgttgctacgttaatttcttatatcaccggcccgatcacagtcatgacattgagacggacggggaaagacctgtacaggcctcttcgtttaaaaggcttaaacgtgattgcgccgcttggatttatcttcgcgtcactggtgctgtattgggcgcgctggccgttaacagggcaggtcctgtttattatcctgatcggtcttccgatttatttctattatcaggcgaaggcgaaatggaaagggtttggccggaactttaaagccggcgtctggatggtgttttatctgctggccatgatggtcatttcttatttgggcagtgataaattcggcggcctgaatgtcattcattatggctgggatatggttctgattgcgatggtatcacttgtattctatgtgtgggcgctgaagagcggctaccagacagaatacttaaaggatgcgaaagagataaattctcagctgcttaatggacagtcagaagctgctgccggaaaagaataaaatacgaagaaaaccttgcgatagttgtcgcaaggttttttctgtttacttgaataacacacgacaactggcttcaaaacagattcattgtttaatcttcgggagcattcctaaccgtgtttatgaagtttgtttaaatttactttaaatgcttcctggaaatactgtataaaaataggtttgtggtaaaattgtctagttaaatgattaattctttattgttacattaattccaattattgaatgtgaataagagttttttaggataaatatatatgtacgtcgaaaggaataggggaaggtatgaaattttcagttgcaataccagtatataatgaccaaaactcaataaaaacatgtttggatagcgtgttaaatcaaactatcggacaagacagacttgaaattatttgtgtgaatgacggttcaaccgatgagagtggtgctatattagatgaatatatgagtaaatatccttgcataaaagtgattcatcaagaaaatagtggagcgcctggccgacctagaaataaggcaatagatattgctacaggagattatatctattttgttgatggagatgattatttagggattgaagctttggaaagaatggaagaaaagattcttgaatatcaaagtgatattgtcataggacgttatgaagggatcaatagaggcgtgcctgtttcaatttttaagagaaacccggactgtttttctttttttggttcaaacgctctttttacaacgagtgctcagaaattattcaaacttgatttgttgaaaaaacataatattcgttttccggaacatttctctctgggagaggaccagccgtttatcattcaggcatatgcctattcaaattcaattgcattggttaaagattacgaatgctattatttgacgaatcatcagaccgttggaagagtccaactaacgaaaaaacctttatccggtaaacttttcatgcttagaattgaagagacattggctgctattgaagcattagaactagacaaggataagaaattaatggtctttcaccaatattgggagagagttttagatgtagaactgagtgcgctcatctcaagatcatttttagtagaggacaaactttatatattcaatacatttaagaaagtccttgataagtatcattatctggattattactctcaattttcatctaggcagaagctattaattcgattgattgacaaaggtaagatggaggatttaattgccttttggtatgcggaaaaacatacgggcaatatggtggtttttcatggacaagtatatccaaaacccaaaatggcttatgaactagcgttaaatgaatccatatcctttcatcggcttaataagtttgaaggggaaataactagattagaacgtttagaaaacactcttttactggaaggattttgttatcattctcacgttgattcatcaaacgaaaatttatttattgaaatctctttaagaggtcagcaagaagaagggattacattaccggccttcagaaacatttatgaaaaacaccacccaatagaaattgagtcccactatttgaaaaaggaaagtgttacctactttcatacctttatcccgatacagtcccttttccgttttaaccaagaaggagacatattggatgtaagattaattagtaagatcgaagattatacgaaatcggtaagattgagagcaaaaccaacagtgttattaaaggagtccttatttatttctaaagagcatacagagtggacattattgtctacctatttaaccaaatggggaaatctttcttttgtattaaaaactcaagagcttgatattcaaaatttttcactatcatacaatgattctgaagtgaaagggtatttcagtttgccatcgagtgtatctttggatgaatcgtcccgctttcaacttatattttcaaaatttcttacttatgaacctgaagttatacttcagaaatccagtggcagcgaacagttgtgccactttcgcttcgcagtctctaagagtgatttaaagcagctgagacaaaaaaagaatgtagaaattgcgatagggcactataagaaaagagtgccagtttattataaagaaagaccctctatcataaaacgcgtactaaataaattaagacggcttttcatttaatatattttcaaatcaaaagagctttgaatccaaggagattcaaagctcttttttttactttttataggattttttcacataatgaaacacatccgggtaattcgtaaacaccccggtaactcccaagtcaagcaggcgatgcatatctgtttcattattgactgtgtaagggtgaagcaggaggccgtggctgcggatcatacggacgttttcttgatttaaagctttataatccgggcccgcaccgacagcgtatgttttgatttcttccagggcagcatctgtcattgacgccatttgtttggcttccagcaattgaacggtcggcaggtttggctgtaattgatggacttttaccagactttctttgctgaacgattgaatgatcacctggcctggcttagaatgtttccccagtaatttatgtttctgcaaagaagcgatcagtttttcttccatacctgggtaggtgtcaggcgattttgtttcaatgtagtagttcgcgtgctttccgaaacggtctaatacctcttctaatgtaggaactttaaggccgacgtactgcggctttgctttttccggatagacttcattaaaccaagaaccggcgtcaagcttcttaatgtctgcgagcgtatggtctttcacccagcccgttccgtttgtggtacggtccagtttttcgtcatgcatgacaatcaatttcccgtcttttgtcatttgcagatccaattcaatataatctgctttcattttctgagcggtttcgtaagacagaatcgtgtgctcaggcacatatccagaagcccctctgtgcgcgacggtcaggatacggtcaggtgacagcaggtttccttttgacgctgccgacactggcgttgtcataaatgcgagtaagcccagcgacagaacaactaaggctagtattctattttttttcatgatttctcctccttatagataagcactacctgtctttcatattaaaaaacggatgtaaacggcgtgttggaaaatgattaatcttttatgtgtctttcttaaacatgctctgcccgttttcctgtattccacgtcaaagccaagaagacgatggcaagaatgcaggaagagatcagcatgataaagccgccgttccaattaaagcggtcaacgacaaagcccataatggcgtttgcgaaagcggatccgccgatgtatccgaaaaatccggtcaaaccggctgcagttccggctgcttttttcggtgctagatcaatcgcttgcaggccgatcagcataacaggtccgtagattaagaagccaatgctgatcagggcgatattgtctactagcggattgccggccggattcagccagtacaccaatacggcaatgaaaacacccgccataaacaaaacgcctgccggtgcccggcggcttttgaagaatcggtcactgatccagccgcacaagatcgttcccggtatgcctgcgtattcgtaaagaaaatacgaccagcgcgagtcttcaggagaaaagcctttggcttctgttaagtaagtaggcgcccagtcaaccacgccgtatcgcacgaaataaacaaatacattggcaaaagcgatgtaccaaagaaatttgttgttcagcacatattgaaaaagaatttcttttgttgttaattctttttcctgatttttaaaagcgtgttttggatagtcattccgatactcttcaattggcgggagtccgcaggattgaggcgtatcacgaaccaataaaacaattaaaaatgaaatgataatggcgatgatggcagggaagaaaaacacgcttttccaagtgacgaacatcgcgatcccaagagtgacaagcggagcaagaataccgccgcctatgttatgggcgacattccagatcgacatttttgtgccgcgttcacttatggagaaccaatgggccattgtcctgccgcatggcggccagcccattccttgaaaccatccgttgataaacataaaaataaacatgatggtgacgctcgaagtcacccaaggcattgaaacgaatagaatattaacgattgctgataaaaataggcctgtcgccagaaaatatctcggattacagcggtcagacaccatccccatgatgaatttgctgaagccgtacgcaatggacacagcggccagcaccaaacccagttctgttttcgaaaatccctgttcctgcagataaggaatggcaaaggcaaagtttttccgtagcaggtagtagcctgcgtagccaatgaaaataccaatgaatacttgcagtctgagccgtttgtatgccgcatccatctttgaatcatccagtctctcaatgtgaggagccggtttaaatatattaagcattaacaattatccccctttgctgtttgtgctggatgtgtggcgtgcctcctttcccgaaaaacaaaaagagccagaaaacaccccttgtcaaaaggggttggattcctggctctcctcatctccatccaagctattaacttatcatgatagcgctttcttaaattatcatagtccggagcgaatgtaaacgggtaattttcaaattgggccttagggaagtaaatattatccttttactaaatgaagttatgtttttttactagtaacataaaaatctggagggaggctgtttaaaggtggatgaattagatatcgcattctttattttaccgttaggaattatgctgctatcgattgtcgggacctgtatttgtaaaaacccgtatctgatgccaatgcttagtttggtgatttctcttgtgctcacctttaccatttttaatgaatcatttttgggatgggctgttgtctatagcttggtttctctggctttatcctatatcacattgattgtggtaaggaaaaggaaggaatcaggaaattaaaaagacctcactttctaacatatcgttgactaaggcaactatatgtgattataattggcttagtcaacaatattagaaagtggggattgatttgaaaacaagagaatcatctgtcggattaaaattcagaaagttcaatcgattttatacaaacgtccttggtttccttaatgagcacatttacgacagcccgttttccttaacagaaacacggattttatttgagatttataatacgcctaattgtacggcaaaagctcttcaggataagctggggcttgaccgggatatgtcagcaggattgtgaagcagtttgaaaaagaagatttgatctataaacagaggagcaaagatgacgcccgccaacattatatttttgtcacagaaacaggaaaaacgatttataaaaagctggaggagaaagccaacgaacaagtagaactgatgctgaaggaaatcaaccaaaaggagcagcacaagcttgccgaggcgatggcagagattgaagcgatcctttcacagtcgctttctgccagaacatcagagatatcgattagagattattttctttcggaggatcttcaactccttattgagaaacaaagacaattttacgcggaggctcacggttgggatgccacgtttttagcttatcttcaggagacatttgacgctgaaatcgaaaaaatatggattgcggaaagcggcgggaaatttgccggctctgtcgggttggtcaagcatgatgaaaagacagtccagctcagatggtttctggttgatgcggattttcggggcagggggctcggcacgcaattgctggagcatctggttgcatactgccaagacatgaagtttgaccgcattttcctttggacggtgagcaccatggccgaggctcgtccgctctataaaaaatttggattcaggataagtgaagtgaaacaagaagcgccattatggggacagcagctgacagaagaacggtgggatgtggagctgtcatgaaaagactgcattatgcttgggtcatcgtctccgtcaccttcttgatcttattggcggttcagggggtgcggctgtcgtttggtgcgtttgtggagccgtgggaacggcagttttcaatggatagaagcaccatctcgctgatttcgacgatgagttttattgtttatggcatatcacagcctgtgattgggcggcttgtggacaaatggggtgctcgggctgttttggcatggagtgcgttactgacaggagtcagcattttcttaacatacctagtgacttcgccttggcagctgtttctgctttatgggctgggtgtctcgcttggagtgggcggagcatcgaatgtggcggcaagtgtattggtcgtcaattggttcagcaaaaagcggggactagcctttgggatcatggaagcaggctttggcgcggggcaaatgcttctcgttcccggctcactcatgttgatccattggtttagctggaagctgacggttgtggtgttgggactgctgttaatcttgattgtctttccggctgcgctgctgatgctgcggaacaatccttcagaaaagaatacagagccgataggcggactggctgcatcagaaaaagaaacagcacccaaacaacagctctttcagtggccgggatgtttcgcatgaggcaattctggttcttgatttttccgtttttgatctgtggatttacgaccgtggggctgatggatacccatttgattccgttttctcatgatcatggcttttcaacgacagtcacgagtgctgctgtcagtctgctggcaggctttaatattgctggcatcttgctgtccggaattgtagcggaccggtggagcagccggaaaatcctgtgctttttatatgcggtgcgggcgctgtcgatcgtgattcttatttacagccacgagccctacttgcttttagcctttgcgattctgtttggattagtggactttgcaacggtagcaccgactcaaatgctcgccacccagtactttcaaaactactcgatcggcctcatgattggctggctgtcactcgcccatcagatcggatcggcactaggtgcgtatgtgcccggcgtcatctatacggtaacgggtgagtatacactggctttttatttgtcgattggaatgctcgtgcttgcgagcgtaatgaatgtgatgctgagggagccatctgcggtcacgcgtgacagtgcggctgtggtagacaagtgatgaggacaaagggaaagcatctctgatttcgagattattcagagatgctttttttgtatttttgttctaatacgaagtcgatcataccgactatgcgggcgttttcggatttttgtttgaagttttgggagacttgaatggcttttgcgtttttaaaacaagaggcaagccagataaacccgacaacaacaaaaaataatctagcaagcaaactccctgcatggggtaattcattagttgtaaaatataaaaatagagtaactaatgtaccgtagattactgtttttatactatgtataagagtcagctgaggctcactaaagaatacttttaattgattcagcatgatagaatcctgtttggttagaaaagtcaggatttctgtatcatgttccttgtactgtttaatagtttcggctatttttacggtttctttaaatgtttgttgatttagagtcatccagtatcctccttaaaagtaaagcactacatgaggaatgatatagatccatagacccatgtagtgctgatatattatttatttgcagaagggaataaagctaaaaacgcacttataaaagctacagctccacctactgctaaggtttcaggtatagctgttagcaaggcagcaattcctaatacagcagccactccaaatgtaatatgagtgagagtagattcccaatctggtgagtatacttcctcagtatctggtaaagtaaagtgcttctgttttattttaaacgtaatcgtagtcgttagtccagttgtgatattgtcaccgactggaatatcaggtgtatagattttaatttgaatatttaaagattcagctgttggatttacgtaaacctccaaataaccgttgcgtactgataagctcagactatttaaaaggttttgataagagtcgatttgtgacgcagtgagagacgtttgagtgtcgcccaataaacccgtgatataggcacctggtttaccatttgtaatggtaattgtgtttggtgaaccttcacttggtatggttgccagaagtgaagttgatagaataatatccaactcaggtgatgtgaaaatggtttctgtcgtatcaaattcaaacatcgcgtttgccaaacttgttagattttctaaagccggaatggtagataaaatgtctgtcagtgtacgcagccttgcatcatataccggatcagacggcggatttacattgcttgcacctgagtctcttcctgaaaatccgtctttatcaatcccgatgcttccagaaccgcttccgatggttccttcataaaattgatcaaaggcccagttgtttggcatcggatagccgagattgccgctaaatcctgttgacatatttgccacaaaactatactttgtcagtcctgcttctgatgtacggatacaaatgtttcttggtccgtaaacccctatttcatacttaggtgcggttgaaaatgtctgcatttttgtaaatgctgacttaatctcttggaaataaggaatgattttatcggtcacttcataatcgtatgcatcaaaatcgacagcgaaataaatggtcgtgcctgacggaaaacctaatcttctagcagcagaagcggcactatatgcatctcttgtgccttggtctttgacaaaataagaagattcatagccgccgtcttgataaattgggaaaaccttcaatccggcatcaagaataactgcaagctctttagatgtcagggcttttgatgtgaggccgctgcttgtccgcacatttccggtcaaatatctgccaaccgttttataaccgttattccgaagtgtttgagctttttctgcggttataattgtagcagtgtcacaagcagaagcggtgcgagttgtgtctcctgagcttgataataaagctttaatggttggcatatctgcataacctgtttgcggcaggcacatgaactcttgaaatgctttaacagctgaaacaacacccacaccatatttgccgtcaaactcaccaggatcgaacgattttccgttacaatagagggcgtactgaacaattaagacaaatcctgttcttgaatcgccgggagttaaagtagggcacaaacttgtggtgccgtttccgaaaaatccattggcaacacttgtgctcatgccttcttctttttgtagggcataaataagagctttatttgtatcgcgaccatacagtccgtcacaaggcattaacccgatatagtcattgtagtcccgatttaagttttgttgaatctggcgaattcttgaatcacccccagacaccagcttaaaagcgctcatgtctaataaggctttcataattaacgtggtgacaatcccatcctgtgttgtcagtccggcagctttttgaaattcttttaccgcattttctgttttttcgtaaaagacacctgtaaaaccgccgggattaaagcctttacaccataaagccccttgtaaaataaaattcatgttgcttggttttgaatctggagcttggcgtttaagaggcttaaataagcgctgtgttgtcggcccgaagttatcggctggctctgagatacccaattcaatttgaagcgcccgagtcagaccgtagatcgtatcccacccagttttcccgctttcttcaactgggttatacccatgtttgccgctgtacgtatcgttcagccattgctgtgtgattaagaccatttcatcaaccatttcgattcctcctttgttagattgcgttcatttataggtggcaaacgtaggacaaaataaaaaaatggatgccgttaagcatccattttacatccgttctccatcagcttcactttcggtttcatctccgaaatgtagaggcctaaaagcgtaagggcgcctcctagaagagcgatccatgtcatgttttcatgcaggaccaggacggaagcggcgattgtgataaccgggaccatgtatatatacgcactggatttgacggctccgagcacgccaactgaataattccaagtggcgaagcacagggcagaagcgccaatccctaagaaaagcatgttgagtatatttgaagcagatgaaaatcggcttaggtccaaatggaagtcgaacaaaaataaagcgggaaccataaataataggccatacaaaaatactctctgtgtcagctcgatgatgtggtattcgtaggcgcttaattttttcatgaatatcgagtatccgccaaacacgagagcagccccggctgccatgatgtctccgagcggatttagacgaagtaccacattgccgttaaacgtaatcaataaaagcccgatcagtgccgagacaaatccaatcaaaaaagtcagacgcagtttttcgccttcgagcagaaaatgggccaaaaccgcagtgatcatcggtataatggacacgatcatgccgacattggatgcgtatgtataggagagagctatattttctaatagaaagtataaggttacgccaaataaaccagccccggcaaacaacagctcctgccgccaatttctgaacggaatcatgttgggacggacgaggataagagcgataaagcccatcaaaaaccgataaaataatatttccattggagagaagtcagccagcagaacttttgtcgaaataaaggtcgtcccccaaatcagaatggtcacaatggctgcgatatgccccgaagtttctctttgtatgttcatctgtgaagctccttttcaaaaatcttcatgtattgcttcggcgtcagccccacctgccgtttaaaaaacttcgtcatatgactctgatcgctgaatcctgtctgaaatgccgcatcaatcggtcttactccttgttcaaggagttttttggcttgattaatcctgattgtttccatgtagctattaggggtaatgcctttttgttttgtaaatgaacgcaataaatgatacttgctccagcctgttaattcactcaaatcattgagtgtgacattttcggcataatgctcttctaaaaattcacaaaccattttgacttcgtctgatggttctggaacgctgctaaggaacgtgacatctgaataatggcggatcagctcctctaatagatgaagaaacagctcctccttacgcaaagcttgtttttcctcggatatcaaaatatgcaattcctgcaggctggctgtcagctcatggcggaataacacatgctgggagaaataagggagatgcccggcgccagtaatctctttcaccgccttctccatgatatccggcatgacattgatacaccgataatcaagcgtccggccgtcaatctgttcacagctatgcgtgtcacgagggttaaagaggagaagatcacctggattgatgatatattcttgatcctgacaggccagataccgttgccctttttcaataaatccaatcacataataatcgtgaaagtggttcgggaacttttgcataattcccttgaaacggtaggcttctatatgaaggtgtgggtcaagctgcagtgtgcgggtttcattttgcatgggatgcctcctgtcggtgtggtggtcttggattaagtgtagcatgattttgggagatttcttgtatgatgttgctgtttaggaatagagaaagcagaccgttattggtctgctttcgtttaagaatttaaaagatttcattcctcaataataattatcccttttttaataaaaatttatttttcaaatatttcagttataatggtttggaacagataggaggggcaaagatgtatcaatcaaagaaggttttattgttaggttcaggtgagttaggtaaagaggtagtgattgaagcccagcgtcttggggtacagacggtggcagttgacagttacgagcatgctccggcgatgcaggttgcgcataatagctatgtcgttgatatgctggaccacgagcagatcagagccatcattgagaaagaaaagccggatttgattgtgcctgaggtggaggcgatcgcgacggatgaattgctgaagcttgaagaggaaggatttcacgtcatcccaaatgcccgtgccgccaagctgacgatggatcgggaaggcatcagacggcttgcggcagaaacgctcggacttgcgacggctggctatgaatttgcgaatacatatgatgaatttatacaagcggcagcacagatcggttttccttgtgtcgttaaaccattgatgagttcttctggaaaaggccaaagtatctgtcgctctgaagcggatttagagagctgctgggagacggcgatggaaggcggacgggtgaaaaacggccgcgtgatcgttgaggagtttatcccattcgaatcagaaatcacactcttaaccgtacgtgcggttaacggtacgacattttgcgagccgatcggtcatgtgcaaaaggacggggattatatcgaatcatggcagccgcatgatatgacagagcagcaaatagaagaagcgaagcatattgcgaaaacaatcacggatgagcttggcggatacggtctgtttggtgttgagttgttccttgcgaaagatagggtatatttcagtgaggtatctcctcgtccgcatgatacaggtcttgtcacgctggtgacgcaaaatttgtcagaatttgcgctgcatgtccgggcgattctcggctttccgattacagaaatcacacagctttctcctggcgccagcaggcccctcaaagcgccggaagaattagcggattacactgttgaaggattggaaaacgcactggcggtcccaaagactcaagtgcgcgtctttggaaagccgataacgaaagtcggacggcgtatggcagttgcgctttctgctgctgatacagttgaaacggcaagagagaatgcaaagaaagcgttgggccagctaacgataaaatagagtttgagcaggctttgtcatggtacaaggcctgtttttttcttccttcataaaagttttatcataagaatcagaaacctgattataatgtaaaagtcttccatccctacgggtggttgacactaaaggagggagatgacaaaatgaaattagttccaagattcagaaaacaatggttcgcttacttaacggttttgtgtttggctttggcagcagcggtatcttttggcgtaccggcaaaagcggcagagaacccgcaaacttctgtatcgaataccggtaaagaagctgatgctacgaaaaaccaaacgtcaaaagcagaacaggtttctgccccttatgagggaaccggaaaaacaagtaaatcgttatacggcggccaaacggaactggagaaaaacattcaaaccttacagccttcgagcattatcggaactgatgaacgcaccagaatctccagcacgacatcttttccatatagagcaaccgttcaactgtcaatcaagtatcccaacacttcaagcacttatggatgtaccggatttttagtcaatccaaatacagtcgtcacagctggacattgtgtgtacagccaggatcatggatgggcttcgacgataaccgccgcgccgggccgcaatggttcgtcatacccgtacggtacttattcaggcacgatgttttactccgtcaaaggatggacggaaagcaaagacaccaattatgattacggagctattaaattaaacggttctcctggaaacacggttggctggtacggctaccggactacaaacagcagcagtcccgtgggcctttcctcgtcagtgacaggattcccgtgtgacaaaacatttggcacgatgtggtctgatacaaagccgattcgctccgctgaaacgtataagctgacctatacaaccgatacgtacggctgccaaagcggctcgcctgtttatcgaaactacagtgatacagggcagacagctattgccattcacacgaacggaggatcgtcatataacttgggaacaagggtgacgaacgatgtattcaacaatattcaatattgggcaaatcaataaatacagcaaactagccatattcatgtctattttgtttttatgcgggtgcagttcgcagacgcattcttctccaaaagaaacgactattcctgtcactcttcatgtggaggatgctaaggggctgccggtcgaaggggttcaagtgacgattgtcaaagcgcctgcctcagacggggagccgagtacagagattggcgagatactcggtaaaacagacaaaaacggagatatcaaatgggataccggcagaaaaggcgattactcagtcgcgttgacgaagggtgaaacatcagtaacccatcacatctcgttaacagaggataaaaaagatcatgccatgccattagtcttcaaagaatagcagtttccttgattttaagggaactgcctttttttatttattacaggaaaccaaactatatactggaaatttattatgtgagataataagaaataggtattttttcttacgagacaaaaggggcgttatcctttattttatattaatcaaacccggaggaaaaagaagaagatgatacaagattcaatgcagtttgccgcggttgaaagtggtctgcgcttttaccaggcatatgatcaaagcctttctttgtggccgattgagtcggaagcattctatgtttctactcgttttggaaaaacacatatcattgcaagtgggccaaaggacgcaccttcgctcattttgcttcacgggggccttttcagctctgcaatgtggtatccgaatatcgcggcgttgagccgtcaatttcgtacatatgcggtcgatataataggagacaaaaataaaagtataccatcagcagccatggaaacgagagctgattttgcagaatggatgaaagatgtctttgattctcttggactagagacggcacacctggccggcctttcgcttggcgggtcccatatcgtgaatttcttactccgcgcgcctgaaagagtagagcgggcggttgttatgagtcccgctgaagcgtttatttcatttcatccggatgtctataaatacgctgcagagcttacaggggcaagaggagctgaatcatatatcaagtggatcacaggcgacagttatgatctgcatcctttactgcaaagacaaattgtggcgggcgtggaatggaaggatgaacaaaggagcctgaagccgacagaaaacggctttccgtacgtgttcacagaccaggaattgaaatcgatacaagtcccggtactgctgatgttcggtgagcacgaggtcatgtaccatcagcaaatggcctttgagcgggcttcggtattggtgccgggaattcaggctgaaatcgtaagaaacgccggacatctgttatctctggagcagccagagtacgtcaatcaacgcgtcttgtcctttttatgcggggggataaactagtaaggaacatgaaaagattggcattcatttttcaaaaggtaacaaatgttgtataataatagaatttgaatgctgctttttttgggagcattctatgttatcatgcttattggagaaaaatttttcctgtaacgctattcgatcactatcgtcaaataatatagatggttttacaattggaggtttggttacactgtgaattacatcccctgtatgattacgataggaaacttcatttgcggattgctggcgattcattccttgctatatcacaacattcattcagcagtgctttttatttttacaggcatgttccttgatttctttgacgggatggctgctcgtaagctgaatgccgtttctgatatggggagagaactggattcgtttgccgatctggttacgtttggggtggctcctgctatgcttgcttacagtgtcgcgttgtataccctgccatttatcgggatcttatgcgcattgacgtacagcatttgcggaatgcttcgcctctctaaatttaacattgaacaaagcaagctcccgacgtttatcggtatgccgattccgtttgcgggcatgtgtctcgttattttaagctttacctataacccgatccttctggcaatcggcacttgcggactttcatatttgatggtgagtaaaataaaattccctcattttaaaaaacatgcggcagaaaacctggagtctgggagatggaattagttcagcagctcatagcggattacggttatctcgctatttttttgatgctggtattaggaattgtaggattgccgattccagatgaagtgatgatgaccgttgttggctatttcacgcataccgatgtattgaattatgagctttcgatattgattagttttgtcggggctttgttaggtatgctgatcagctacatgattggcagaaaagccggacgcccgtttatcgacaagtacggcaagtgggtcggcttaaaagaaaaaagaatgatgaaagtggaaaaatggatgaagaaatacggtccatattctcttattttaggttattttattcccggcgtcagacatgtgacgtgctacttttcggggatcggcaaaatggatctgaaaacgtatgttgcgtttgcggcaatcggcgcctttttatggtgctttgtttttattacaatcggaagggttatagggattattcatgtttaatacggctgtaaagattctgtatcgatcattgatagagctgacgaatcatcgtctgtcatcctatctgattaaaggattttgcgagtcaaaaatcagcaaaccggtcattccgcttttctcaaaacattttcggctgaattgggatgatgtggacggtacggctgctgattacggatcgctgtctgaattgtttattcgacaaataaatctggagcggcgccctgtgtcaaaagaggcgcatgcggtggtcagccctgttgacggtgtggttcagacggtaggaatcatcaacccgaatcaaacctttacggtgaagggaaaagattactcattcgctgaactcaccggctgtaaaagcgcagaccatcaatacaacggcggatacttcgtcgtgctgtatctaagcccgaggcattatcaccgtttccattctccgatcagctgcaggtatcaaaagctggccgagctcggaaatcgctcatacccggtaaatcaactaggcttaaaatacgggaaagatgtgctgtcgaaaaattatcggtttgtgtacgagctgaatagcggcagccgaaatgtcctgatgattcctgtcggcgcgatgaatattaattctatcgtgcagacgagcacccgtgctgaattggagatcggcgaagagctgggatacttttcatttggctcaaccgtcattttgatttttgaaaaagacgcgttccagccgtccgcccatttagcagaaggccaagaagtccaagtcggagaactgataggttacgaagagtaagaagaggagcttgcataaacgcagcgcctctttttttgaagaaaggtgagattcatggagaaacaaatcatcagctggattacagattatcagaacaccggagatgaagccgtcctgcggcaagtgcgagaagtatgctggccgatcgttgaagcggttttgcaagagaaggcaatagatgatgaacaagcgaacaatttgcgtgaaaaaggaatcgagcggtttccattcatcatcagcaaataccaagcggatgtgcagcttccggttgagacatttttacgaaatacgtatcggttttactttcatcaggtgatgagagaatccagctaaagcttctttcaacagagaagctttttttgttggcaggaaaaggaaactttttctatatctatctcgtaatgactagagaacctaattggggattcacagaagagcagatgatccttaaggaacaatatgacggtgtcatttggctggagcatatcacgccgtcagtcattatcaagtgagcggtgtcccctgtgctataacaggtggagttcaccttttgtttgatagttttcagataactacattgattagtaaatgaatggaaaatacttgtgtgccgtgagaaacccttgtgccgcttaggtttgtaagagcttggatatttttatcagtctgggcggatctgttcatctttgcggcattttcctgtatgatatagtaagagtgtgcatagcaactaactataattgaacagggtgtttaaaacatggaaaaacaatacagagtattactttactataaatatgttccgattgaagatccagaggcgtttagagagcagcatctggctttttgtaaggagcttggtttgttaggccgtatccttgtttcttctgaaggaattaacggtacggtatcaggtacggttgaacagactgaaaaatatatggaaacaatgaaagctgatcctcgttttgcggacatggtatttaaaattgatgaagcagaaggccatgccttcaaaaaaatcttcgtccgccataaaaaagagcttgtaacgcttcgtcttgaagatgatgtcgatccgaacgaaacaacaggccagcatttgaagcctgcagaattttatgagaagatgcaggatccaaacacaattgtcatcgacgcgcgtaacgattacgagtatgaccttggccatttcagaggtgcggtccgtcctgacatcgaagccttccgcgaattacctgaatggatcgaagaacacaaagatatgcttgaaggcaaaaagattttaacgtactgtacaggcggcgtgcgctgtgaaaagttctcaggatggctggtgaagcaaggctttgaagatgtagcacagcttgacggcggaatcgtgacatacggaaaagatcctgaagtgcaaggcaagctttgggacggccagtgctacgtatttgatgaaagaatcagcgtgcctgtcaaccgtgtcgagcatgtgattgtcggcaaggactactttacaggagaaccgtgtgagcgttatgtgaactgtgcaaatccatcttgcaataaaaaaatgatatgcacaccggaaaatgagtataaatatatgcgcagctgcagccacgaatgccgcacgaacccaagaaacctgtatgtgaaagagcataatatgacagaagaagaagtaaacgcaagactggcagcgattgaaacagaagatcatgctgctgctgaataataaaaagaacacctcggattgaggtgttctttttttctatatgctttcggtttggctgtttgcggaaacccattctttttggcggaaggccttttcccattttgataccacgatacaggcgatcgcatgtcccggtacgttcacgcctgttctcgccatgtccatgacgcggtcaacacccgcgataatggcaacgccttcagccggcagacctacagcattggcagtcgccagaagaactacaagcgatcctgagggtacagctgcaatgcctttactggtcatcacaagcacaagcatcatgagcagctgctgggacaatgtcatgtctacttgaaaggcctgtgcgagaaagatacaagaaaccgataaatataagctggagccgtcacagttcaatgacaagccggagggaacgacaaatgataccactcgtttgggacagccgtatttctccattctatccatcagctgagggagaatggtttcagtgctggtggtggaaaatgcaattaaaaacagatcccatatcattttcaatacttcgaaatacttaatctgaaagatgagaccgacaagcggaaagaggacaaagaggatcaggaacaggccaaggaatacggtgccaaccagcttaaacatagggaggaggagttcaatgccatattggcccacagaagctgccatcagggctaacacgccgataggagcagtgaccatgacgatttgcgtgagcttgaacataatctgagcggtagattcaaagaacttcattactggttcagaagctttgccgataccagcggcggcgacaccaaataaaatggcgaagaaaataacagcaagcaaatcatttctggccatgacatcaataatgtttgtagggataatatccaggatcatttgcttgaaatcaacaactttgtctgtgtagccggaaagttcatgaatatctttttttgccaaatgggagaggtcaagcccgacacctggttttaagacattcgctaataaaagtccaagccctaataccaacgttgtaatcacttcgaaccaaatgatcgtcttgatgccgaggctgcccatttttttcatgcttccgcttcctgcggctccaatgacaatggtagaaaatacaatcggcacaacaatcattttaatcaggcggataaatccatctccgacaggcctcagtgccatcccgaaatcaggaaaaaagtggccgatcaccgcgccgacagccaaagcgattaaaatttgaaacgcgattaattttttcaaatgaatccccctttagaacgatagaatgtaggcatattcatatcattcgtgattcaaatgcaaacaccttttttcaagttattttattttgacagcgctttcattatgttggcgaaaaagtcccccacagcaggggggacttttttacttcatttgaatgtgctttagatcttcttcagaggtatttgtgaaaataaccggtgttatggctgaagcggcatgctgcttgatgtaatcgagatcaaaggtgagaagcagttcgccttgtttgacggcttgtccgcttgtgacatgtgcgtcaaagccttccccatttagtttgacggtatcaacgccgacatgaatcaggatttcagtgccgccggcgctcataaagccgatggcgtgttttgtcggaaaaatcgagacgatctcgccgtccgcaggtgcaacgacttttccttctgatggtataatcgcaaatccctcgcccatcattttttctgaaaagacttgatcaggcacatcccctaaagagactgtttctcctttaatcggataaataaaggtctcaccggaatcgggcttctgcggtttgtcagttaccgtgtccagcgcggcggcggtggcagggacgcctccggccatgattgttttgatgtcgtcttttaaggcatcggacttggttccgaatattgcctggaagttgttgttgacctccagcacacctactgcaccaagccgttttaattcatccttgctgacttggcttggctgatgaacggtcacacgaagcctagtgatacacgcatccaggttagcgatattttgctgtccgcccaaggcctgcagcacgtgaaaggcaagctggtcttttgcaactggagttttctcctcattctgaccgtcttcatctgtctcacggccgggcgttttcaaattccatttcagaatcgcaaatcggaacaaataataataaatgaaagcaaacacgatcccgacaggaatgacaacccagccgtttgtagacagtccgtagttcaagacgtagtcaattccgccgcctgagaacgtatagccgtggcggacatggaataaatcacaaacgacaaagatgacgccggcaagaatagagttaatcaaatagagcacgggcgcaacgaacaagaaagaaaactcaaccggttctgtaattccggtcagcatagatgtgagcgccgcagaaatcatcacgccggagatcatttttttcttttccggacgcgcggtatggataatggcaagtgcaactgccggcagacagaaaatcatgtaagggaaatcccccatcataaagcgcccggctgtcgggtctcccgcgaaaaaccttgtcaggtcgccggttacggtgttgcctgttgatgggtctgtgtattctcccatcataaaatagaaaggcgtataaaaaatatgatgcaggccaaaaggaatcagcaaacgatagatcgttgcataaaagaacaggccgactgttgaatcggcaattaaactgctggctgcgttaattccgttttggatcagcggccaaacgaatgagaaaatgacgccgatcaccaatgaactgacggaagtaataatcgggacaaagcgttttccagagaaaaatccaaggaccggatgcagctcgattgatgaaaaccgcttatataaataggcggcgagaagcccgataatgattcctccgaaaacccccatatcaatcaggtgctcggctccttcatacggaggctgaaggccgagtaattttcccatattgtcgagggtgacggttaaaattaagtatccgatgacagcggcaagtccggctacaccttctccgccggctaatccgatcgcgacccccacggcgaaaatcagcgggagattatcgaatacaacgccgcccgcatcctttataataggaatgttcagtaaatccttgtctccgaaacggagcaaaagacctgctgccggcaggacggcaaccggagtcatcaacgcgcggccaagctgctgcagaatttgaaatgcctttttaaacatgacagtctccttttattgtgttatgagaatgatgcactctttaatttttgagctgctttataatcggcgataacggttacatgattgtgtatttgaagaatagaggctggtacatctgtcgtgacaggaccttcagccatcttttgaatagcgtctgctttttcctcgccgcttgctaaaagcacaatatgtttgctgaattccatgatggttttaatgcccattgaaatcgcgagtctcggcaccagcaccggatcgccgccgaagaatctggcatttgcctgtatcgtgctttccgagagcttcacaacacgtgtccggtcttcaaaatcagatcccggttcattaaaaccgatatggccattggcgccgatgccgagaatttggacatcaatgcctcccgcctggcggatgagatcctcgtatactttgcattccgcctcaagctgcgggttgtctccttgcgggatatgaatatgatcaggctgcatattgatatgctgaaaaagatgctcatgcataaaatggttataactttgcggatgagatggagagagaccagcgtattcatccaaattaaatgtagtaacctttgaaaaatcaatttcgcctgcctgatagtctgaaatcaactgcttatacaagccgaccggtgtgcttcctgttgccaggccgagaacggcatctctcttagcttgtatttgttctttaataatggcaacgcttaacttacagagttcttcatagtgctcggcgatcagaatcttcatgtgacaccccctcaaagagatagacaagcaccatatttgttatgaccaatttatgatacttgtaattacgaatttagcaccaccattattaaactgtcaatattaatttctgaaaatttgttataaaagaaggatacaaatctttcatattgggatggcaaatggtattatggtctcaatgaaaaagaacggattgcatacagaatggggagaatgaaatgacagctttatattctgttatcaagtttaaaatcattgagttaattaaatcaggcaaatatcaggcgaatgatcagctgccgacggagagtgagttttgcgaacaatatgatgtcagcagaacaactgtgagactggctctgcagcagctggagcttgagggatatattaaaagaattcaaggaaaagggacatttgtatcggcggcaaaaatacaaacgccgattccgcataagattacgagctttgcagaacaaatgagaggccttcgttctgaatcaaaagtgcttgagcttgtggtgattcctgccgatcactccattgccgagcttttgaaaatgaaagagaatgaacctgtcaacaagcttgtcagagtcaggtacgctgagggggagcctttgcagtatcatacctcatatattccctggaaggcggcaccggggctggcgcaggaggaatgcaccggctcgctgtttgaattgttaaggacaaaatacaatattgaaatcagcaggggcacggaatcgatcgaaccgattttaacggatgaaacgatcagcggccacttattaaccaatgtcggagcgcctgcgtttttatcagaatcccttacctatgataaaaatgaagaagtggtggaatatgcgcaaattattacccggggagaccgaacgaaattcaccgtagaacagtcatatcattcataaagcaatgtgttttaagaagggaatggtggttctatgtttttattgacgaatggaaaagtgctgtggggagcagtgattgctgcattcatcctttcaattgtattttacccttctctgccgacgcagatgccgattcattatgatgttgcgaacagtccgaatctgacggttaacaagctggcggggactgtgatgctgcctgttttgatggtggtgtttgcatgggcgcggaagatcaattggcaattagtgttcgcagtgtatattttgctgatttgccacattgtcgtcctttgtttagcggtctaaatcaaacagccagaataaaactggctgtttttctttaatttcagcttcatctgacaatgaatgtggtgtataatagctgatgatcctaaagaatattctgaaatttataggtgtgaagcggcgtattattaaaggaaaggctgtatactttttgcagctttaaaaagactgaatatttaaacaattatgtgaaaggtgtgctgattagattgaataagcttattgaacgagaaaaaactgtatattataaggaaaagcccgacccgtcttccttggggtttggacaatattttacagattatatgtttgtgatggactacgaagaggggattggatggcatcatccgagaattgcgccgtacgcaccgcttacgcttgatccgtcttcatctgtttttcattacggccaggctgtttttgaagggttaaaagcatacagaacagaggatggcagggtgctcctgttccgtccggatcaaaatatcaaacggctgaacagatcgtgtgagcgcatgagcatgccccctttagacgaagagctggtgcttgaggcattgacgcaattagttgagctggagaaagattgggttccaaagaaaaaaggaacgtcactgtatattcgtccttttgtcattgccacagaaccgagtctcggtgtgaaggcatccaggagctatacatttatgatcgtgctttcgcctgtcggctcctattatggcgacgatcagctgaagccggttagaatctatgtcgaagatgagtatgtgcgggcggtcaacggaggagtcgggtttgcaaaaacggctggaaactatgccgccagtcttcaggcacagcggaaagcgaatgaactgggctatgaccaggtactgtggctggacgccatcgaaaagaaatatgtggaagaagtagggagcatgaacatctttttcgtcataaacggggaagctgtcacacctgctttaagcggaagcattttaagcggggttacacgtgcgtctgcgattgaattgattcgaagctggggcattccggttcgtgaagagagaatatcgattgatgaggtgtatgcggcctctgcacgcggagaattgacagaggtttttggcacaggcacggcagcagtcgttacgcctgtcggtgaactcaacatccatggaaaaacggtgattgtaggcgacgggcaaatcggggacctctcgaaaaagctgtatgaaacgataacagatattcagcttggcaaggtaaaaggcccgtttaactggacagtggaagtgtgaaaactgaaaaagaacctgcccggaggcaggttctttttattttgaatgagtcatatcagcagccggctggcttttgcggttttttacataatatattgcatagcaaatggccataaatggaacgccgcaatagagtgcgattctttgattcggatcaaaggcaatgccaacaacggaagccaggcataacaggaacgcagcaatcggcacgaacggatacaaaggggttctgtatttcaaatcagtaaccttgtttcccgcttcgatataacgttttctgaacatgaattgagaagcagcgatacccatccacacgacaacgacggcaaaaccggaaatcgacacgagcacaacgtatacagtgtctggcgcaaatacgctggacagcaacgacagaatgccgccgatcatgctgaacaccagcgcgttaaaaggggttccttttgacgtcagctttgcaaatgtcggatgaagcgttttttcttttgataaagaccacagcatccgggaagaagcgtagagtccggaattagccgctgacaggatcgctgtcaggataacaaagttcatgatatcggctgcgtatggtacaccgactctgtcaaagacagcgacaaacgggcttttgatgacatctgcatcttgaatcggaatcagccctgacagcacaaaaattgttccgacaaagaagagtgagagacgccagaccgttgttttaatcgcttttggtattgtcttgtcaggatcaacgctttcaccggctgcgattccgattagttccgttcccgaaaaggcaaaattaacggacagcatcgtcatcaaaatcgggacaaatccatttggaaaaagcccgccttccgccatgaagttggacagcatcggagcggcttctccgcctttgatcgggatgatgccgaacatggcagagccgcctaaaagaataaataatacaatggctaatactttgatgctggaaaaccaaaattctgtttcggcgaaaaacttgaccgaaaatgcgttaagcaagaaaatgaacagcgcaaagacggcactccacatccaaaccgatgtatggggaaaccagcgctgcattaacaggccggctgctgtgaattctgatcccaatgccacggtccatgtcagccagtacagccaagcgaccgtaaatccggtgcccggccctatgtatttagctgcataggtgtgaaaggcgccggtcacaggcatggcgactgacagctcaccgaggcagagcatgaccagatagacgatgccggccccgactaagtaggcgagtatcgttccggccgggcctgcttgctgaatggtataacctgagcttaaaaacagcccggttccgatgacacctcccaaggaaagcataaagaggtgccggcttttcatacttctctgaaaggttgtctcattcttgttgtgggcagagttcatctttttccaactttctatcagcgatttatttccttcctaataaaaaatctcatgtcagaaagtgacacgagactccggcgaaccggctttaagttagaatatacaaactattccgataagtcaagttgtttttaaagagcgggcccaagccgcaatttcttgaatattttcgggttttgtccggcagcagccgccaatcagcctcgctcctttttcatgccaggtgcgggcgctcgccccgtaagattctgcgcatgctgcgccgttccacgtttttgtttccggatcatattgctcacctgaattcgggtagacaatgatcggttttgacgtgttcttttttaactcctctatcaaggaagggatatgctgaagcggcgtgcagttgatgccgagtgctgcaatttggcggtgtccatcaagccacgatgcacagtcagctgcaggtgttccgtcactgatatgcaggccgtctttagcgctgaagctgatccatgcatacgtttcaggaaattccttcaatagccgaacaatcgctttggcttcagtcagacacggaatcgtttcgcatgccaaaacatcagctccggcttcaatcagtgccttcatccgggggcgatgaaattcaatcagttcatcttctgatattgcgtagttgccgcgatactcagacccgtctgcaagataagcgccataagggcctacagaagccgcaatgatcggttttggccgattcaaacggttctcttcaagcgaccaaaattcatcacgtgcttcagttgcgatgctgacggacaactcgatgagccggcgtgcttccgcttcgctcagcccgcgtgcggcaaagccttcaaatgtagactgatagctggcagtgattgcacaatcggcgcctgccgcgaaataatcagtatgtacttgtttaatcagatttggctcttccatcaggatttttgccgaccacagactgtcattcaaattacagcccttgcgttcaagctcggtcgccatggcgccgtctagcacaataagcgggtatgtatctaatatgtgttggataggattcatagaatgtaccgatgccttctttcagatttttttgaaaaagatatgaaaatcgtaatggaggcttacgtgtttgtcaataaacgcaaaaagagaaaggtgttcagcccatatgtctgaacacccttttcttatgatatttgtttgttgtgcgtgtcagtctttgtgtctgaaaccggccagcactcaatgccattatggtttttgagcacatctttataaaagaccggatccttgcctgctttcttctggcgtgtatagtctttcagcgccgtaaaaacgacctttgatagtaagaaaatcgcgattaaattcacgacgaccatcaaacccatgaacaaatcagcaagatcccagacgagctggactttggcaacacagccaaacacgatcattgccagcacgccgatacggtagacaaaaatcagttttttgcttttgttcaaaaagccgatattggtttcgccataataatagtttccgattaaagcacagaatccgaataacaaaatcagaatggcgagaaagcctgatgcccatgatccgacatgggagctgagagaggcttgtgtcaaggcgattccgctcagacccggagtatggtaggcatccgaaaacaggatgataaaggcggtgcttgtacaaatgaccagtgtatctgtcagtacaccaaaagcttggatcagcccctgtttgacgggatggcttgttgtggcggtggcagcggcattcggtgcgcttcccattcccgcttcgtttgaaaagattcccgtctgacgccttgcatgagtgccgcgcccaaagccccgccggcggcctggtcaaaaccaaacgcatttttcacgattagcgcaagcacacctggcagctgcgtaatgttggagaaaatgacgaaaaacgcaactccaatatacaggacagccaatacgacgacaatggattcagccagctttgcaatgcgcttgactccgccaaaaataatcgtgccgaatacagcaattaaaatgagtcccaatgtcaggcggtttgtgccaaacgcgttttcaaaggcaaggctgactgtattggattgaaccgagttgaagacgataccgaacgataaggtgattaacacagcgaacagcgcgcccatccaccttttgttcagccctttttccatgtaatacgccggcccgccgcggaagccgtttacatcttttactttataaatctgagccagtgtgctttccacaaagctggatgctgatccgataatagcgataatccacatccagaagattgcaccgggcccgccgagtgcaatggcgatggcaatgcccgtaatatttcccgttccgacacgggccgccatgctgatgcaaaaggcttgaaacggagaaatgctgttttttgaccgggaagcagcaccttctcttaataccctgaccatttctttcagcatgcgaacctgtaaaaacttaagcctgaacgtaaaatagattcccagagaaaggagcaaaacaattaatagctttgaccacaaaagatcatttgcaataccgacgatatgttccaggatttgctgcatacaatcacctcttttttcatgtttaaaaaatgctgagctcccactcctgcgccatatgcttcagcagcataccgccagtgaggctgttgccgtattcatcaatggcaggcccgtaaatgccgatgccgcatccggattgaaaaggctgttctcttctggcacttggaggcaccagcgccatgatgccaccggagacgccgcttttggccggcacgccgacaaacgccgcatatttgcctgaagcgttgtacatgccgcacgtcagcattaatgccttggccaattttgccacatcttttggaatcacctgctcgcgtcgaatcggatgatacccgtcatgagcaaggatcaggccgatcaacgcaatgtcttctgtggtgctctccatagcgcattgcttcaagtacacctcaagtgtttcttctacgtcagcttctaaaaagtttgtttcttttaaatagtaggccagcgctctgttgcggtgggcggtttcccattcagaacggaatacttcctcatgaattctcggccgttttcctatcaaagtttccatcaccgagtaaagaaactcgagcttttcgtatgccgattctccgggaaggatcgaagcgatggtgagggcgcccgcgttgatcatgggattgaagggctttcccggcttgttgatttcgagccgaataattgaattaaaggcgtcacctgtcggctcgacatctacgcggtcaagcacatagggaatgccgcggctcatgcaggcggcaataaagctaatcacttttgaaatgctttgcagggtaaaagagacgttccagtcgccggcgtgtatcatcgttccatcaggctccaatacacagatgccgagctgtgaatcattgacttttcctaaagcggggatatagtttgcgctttgtccattggcggcaaaagggcgatagtattcaacccaatcatgaagctgtaacgccgggtttatgtctttctggtgctcttttatcaattctttcatcgaattcctcctcactgatttttttcttaaaggactgaggtgtatcaaaacgaaggctaaaggggcgttaaacgctttcataatagcggaaggtataattactgtataatggagactacagaatcatacaaaatacgacaaaaacattttgaaaataagcagtaagatttataaaaacctcatgttctgggtcaaaagcaatttgcaggttttctcccgattccccaaaataaaaagcgaggatgtgatcaacataaaactggaacggtttattgaaaaagacggatatatactggccctcatgctgattacggtgccgctggccggtgaactgaaattttatcccctcaatgaagaattccgggtcagctttgggcaccggtttttttcttctttttatcattgttgcggcatgtgcccgctgtgctgccgggttttctgactggagcggctgttttcatctttcgcgtctttctggaattatggggcggaggacacaatggactgactccgattctgtatgatcaagcgtctggctttttcttttatatgacttacgcctgtctgttttccatattaaaggccaatcgtttccgtgaacggccgattatgctcggtttcattgggtttatgattgaagttgtgtcagattgtgtcgagctggctgtgcaatttctcatttttcatacggttgtcacgcctgagaaaatcactgacattgcggtgattgcgatttctcacacatttattgtgatgagcttttatagtgtgctgaagctatatgaaacacaatcgagagaaaaacagacaaggcagcagcacgagcacatgctgatgatcgtttccaatttatatgaagaaacggtgcacctaaaaaagacattgaaaacgacagagaaagtgacaaacgattcgtatcagctctatcgggaaatcaagggaaaggatgttcagctgagcggcagaatcctgagactggccggagaaattcatgaagtgaaaaaggacaaccagcggatattcgctgggctatcaaaactgatttcgaatgagagtttgagagattatatgagggcttctgatttgctgcagctcgtgattcgaatgaatgaaaagtacgctgaagcactagggaagcagattgatttttactgctcgatcgagggagagcatgacgaatatcacgtatttatcgtgctttcgatcattaataatctaacagcaaatgcggtagaggctatggatgaagagggaatggtcagcctgaggctccgtaagccaaatgagagtatggtagaattccaggtggaagacaatggcccagggatttccgagaaaatcggagacattgtgtttgacccgggctttacttcaaaatatgacgaatttggcacgccttctacaggtatcggactttcctacgtaaaggaaatcgtgacagagctagaaggggatatcacatttgataatcagcagcggggagtggtgtttgccatcaggctgcctgtccggcatttgattcagaaagggtgaaccgaaagctatgcgtttttttattgcagatgatgaccgtgcggtgcggtcaattttaaggcagatcattgaggacgaagatcttggggaagctgctggtgaagctgacgacggaagccaagtggaagggcatatgctgcaatttaagcagattgatattttattaatcgatctgttaatgcccggaagagacggcattgagacgattcgtcagatccagaatacgtactccggcaaaatcgtaatgatctctcaagtggaggcgaaggaaatggtcggggaagcgtactcgctcggcatcgaatattttatccataagccgattaaccgcattgaaattgtcacggttctccaaaaggtgaaggagcggatcgagcttgaacactcgattggagccattcagcattctctaagccggcttgtcaatcggactgaacggaaagcgagtccccagcagaagaatgacagcggtttaaaagaggcaggaacattcctgttgtccgagctgggcatgatgggagaaggcggcgcacatgatctcatggcggtcctgcagtatttagcagaacacgagcaatccgagccgcacgaaaaacaaagcccttcgctaaaacaaatattcacccaagtagcggtacggaagctggggacaggagcctcacagacggaagtcaatcgcgaaatgaaagcctcggagcagcgtatccgcagagcgattattcattcgctgcaccattttgcttcactgggtacaactgatttttcgaatccaaaatttgaaacctatgcatcgaaattctttgattttccggttgtcagccagaaaatgaaagaactccaatccaaggatgcaaaaccccttgcacctgctagaataaatatgaaaaaattcatccacgtgttttttttggaagcaaagcttttgcatgagacgatgaaacaaagaaggatataaaccaaacagccggctgaccaggctgtttttttgctgcgcagaatcccggccggacagtgatttaccgcttttttataaaatatcagaaaataaagatattgacttattgtttatttgtcttacaattaaacaaaaggatatatgggaaggagcggatgtgaaagaaaaattaataaaagcgcttacagatagaggccgtatacacaaataacaggaggttatgttgatgagccgtatcagaaaagcacccgctggaattttaggttttccggttgctccttttaacacacaaggaaaactggaggaagaagctctttttcaaaacattgagtttttgctgaatgagggcttggaagcgatatttatcgcttgcgggtctggtgaattccaatctctcagccagaaggaatatgagcaaatggtggaagtcgcagtctcggcagccggaggaaaggtgccggtctacacgggggggcggcaacctcagcacagcgcttgaatgggcgcagctgtcggagaaaaaaggcgccgacggctacttgattctgcctccgtatttggtgcatggcgaacaggaggggctgtaccagtatgcgaaaacgattattgaaagcactgacttgaacgcgattctttatcagcgcgataacgccgttctctctgttgaacagatcaaacgtctgaccgaatgtgaacagcttgtcggtgtcaaagacggggtaggaaacatggatttgaatatcaacctcgtctatacgatcggcgaccgcttaggatggctcaacggaatgccgatggctgaagtgacgatgccggcttatctgccgatcgggttccactcttactcttcagcgatttcaaattatatcccgcatatttcgcgaatgttctatgatgcattgaaaaacggaaatgacgagcttgtgaaggaactctatcggcatgtgattctgccgatcaacgacattcgcaaacaacgaaaaggctacgccgtatccttgattaaagccggtatggaaatcatgggtttgaatgtaaggaatacagccagaccgcctgtcggcccggttgaaaaagatcattatcagcaattggaagcaattttgaagcaggcggctgaccgttttccgaaaaaagccgcgacggtttgaccagaaaaaacacgaaaggggcaatgggcatgtctgtgatcacggaacaaaacacgtacctcaactttattaacggagagtgggttaagtctcaatcaggcgatatggtcaaggtcgaaaaccctgccgatgtgaatgatattgtcggatatgtacagaattcaacggctgaagatgtggaacgtgccgtcgccgccgccaatgaagccaaaacggcttggagaaagctgacgggtgccgagcgcggccaatacttatacaaaacagcggatatcatggagcagcgcttggaggaaatcgccgcctgtgcaacgcgtgaaatgggtaaaacattgccggaagcgaagggagaaacagcccgggggattgccattctgcgctattacgccggagagggcatgcgaaaaacgggtgacgtcattccgtctactgacaaagacgcgctcatgtttaccacccgtgttccgctcggtgtggtcggcgtgatttctccgtggaacttcccagtggcgattccgatttggaaaatggcgccggcattggtatacggcaataccgttgtcatcaaaccggcgacagaaacagctgtgacatgcgcgaagatcattgcctgctttgaggaagcggggctcccggcaggggtcatcaatttggtgacaggcccgggttctgttgtcgggcaggggcttgctgagcatgacggtgtaaacgccgttacgtttaccggttcaaatcaagtcggaaaaatcatcgggcaagccgctttagcgaggggagctaagtaccagcttgagatgggcggcaaaaaccctgttatcgtagctgatgacgctgaccttgaagctgcggctgaagctgtcataacgggggccttccgttcaaccggccagaaatgcaccgcgacaagccgtgtcattgtacaaagcggaatttatgagcgctttaaagaaaaactgctccagcgcacaaaagatattacaatcggagacagcttaaaagaggatgtctggatgggaccgattgccagcaagaatcagcttgataactgcctgtcatacattgagaaaggcaaacaggagggggcttcccttttaataggaggagaaaagctggagaacggaaagtatcaaaacggctattatgttcagcctgccatctttgacaatgtgacatctgagatgacaattgcccaggaggaaattttcggtccggtgatcgccttgatcaaggtggactcgatggaggaggcgctgaacattgccaatgatgtgaagttcggtttaagtgcatccatcttcacggaaaacatcggccgaatgctttctttcattgatgaaatcgatgccggactggttcggatcaatgcagaaagcgcaggtgttgagctgcaggcgccttttggcggcatgaagctgtcgagctcccactcccgagaacagggtgaggcagcgaaggactttttcacagcgatcaaaaccgtttttgtgaagccgtaatggtgctggaaagaggcatgcgtctctttcccagctttatcacagccagcatatgattctctactttgaaaaggagaagatactatgaaaaaagactttgcgagtgttacaccggcgggcaaaaaaacgtccgtgcgctggttcatcgtgtttatgctgtttcttgtgacctctattaactacgcggatcgagcgacgctttccatcaccggagattccgtccagcatgatttgggattggactcggtcgccatgggatatgtcttttctgcctttggctgggcctatgtcatcggacagcttccgggcggctggctgctggaccgttttggttcaaagactatcattgcgttaagcatctttttctggtcgttttttacgctgctgcaaggggcgattggctttttctccgccggcacagcgattatcctgctgtttgcactgcgttttctggttggtttatcagaagcgccttcatttcccggaaacggcagagttgttgcctcatggtttccaagctccgagcgcgggacagcttcagccttttttaattcagcacaatacttcgcaatcgtcattttttctcctttaatgggctggcttacccactctttcggctggcattccgttttcgttgtcatgggtattgcaggcattcttctggctgtcatctggctaaaaacggtgtatgaaccgaaaaaacatccgaaggttaatgaagctgagcttgcgtacatcgaacagggcggcgggctgatttccatggatgacagtaaaagcaaacaagaaacagaatcgaaatggccgtatatcaaacagctgttaacgaaccgcatgctgattggcgtgtacatcgcgcaatactgtattacgactctcacctatttctttctcacatggtttccggtatatttggttcaggcccgcggcatgtctattcttgaagctgggttggtcgcttccctgccggcgctgtgcggatttgccggcggcgtccttgggggcattgtgtcagacatcttgctcaaaaaaggccgttcactgacctttgcaagaaaagtgccaatcattgccggcatgctgctgtcttgcagtatgattgtctgcaactatacagattcagcgtggcttgtcgttgttattatgtcgctcgcgtttttcggaaaaggcttcggcgcattgggttgggctgtcgtgtcggacacgtctccgaaagaatgtgcaggattaagcggcggtttgttcaacactttcggcaatattgcctcgattacaacaccgattattatcggatacattgttaatgccactggatcttttaatggcgcgcttgtgtttgtcggcgctaacgcgattgcggcgatcctcagctatttgctgctggtcgggccgatcaaacgggtcgtgttaaagaaacaagaacaagaccccgatcaatcgttgcctgtctaatatttatgaaagcgctttataaagggaggaaaatgcatgagttcaccgatacaagagcaggttcaaaaagagaaaagatcgaatattccctcaattactgaaatgaaggtgattcctgttgcgggacatgacagcatgctgctgaatctaagcggagcacacagcccgttttttacccggaatatcgtaatcttaacggacagcagcggaaatcagggagtcggcgaggtgcctggcggagagcatattcgccgcacactggagctttcagagccgcttgttgtcggaaaatctatcggtgcgtaccaagcgatattgcaaacggtcagaaagcagtttggcgatcaggacaggggagggcgaggaaaccagacgtttgatttgcgcaccactgtgcacgccgtcaccgcactggaagcggctttgttagatttgcttggaaagtttcttcaggaaccggtcgcggctttgctgggcgaagggaagcagcgtgatgaagtaaaaatgctcggctacctcttttatatcggcgaccgaaagcggacgaccttgccgtatcaaagcgatgagcagtcagattgtgcgtggttccgtctgcgccatgaggaagcgctgacgccggaggccattgtgcgtcttgccgaatccgcacaggagcgctatggctttcaggatttcaaattgaaaggcggggtgctgcgggagaagaggaaatcgaagctgttaccgcattatcgaaacgttttccagaggcaaggatcactcttgatccgaacggggcatggtcattagaggaagctattgcattatgcaaaggaaagcaagatgtgctcgcgtatgcggaagatccgtgcggggatgagaatggctactccgctcgtgaagtaatggctgaattccgccgcgcgacagggcttccgactgcgacaaatatgattgcgactgactggcgggaaatgggtcacgcgattcagctccatgcggtcgatataccgctggctgatccgcatttttggacgatgcaagggtcggtgcgggttgcgcaaatgtgccatgattggggtttgacatggggctcgcactccaacaatcactttgatatttcccttgcgatgtttacccatgtggcagcagcggctccggggcggatcacggcgattgatacccattggatctggcaggacgggcagcgattaacgaaacagccttttgatatttcttctggctgtgtcaaggtgccggataagcctggactaggcgtcgatattgatatggaacaagtggaaaaagcgcatgagatctaccggaaaatgaatttaggcgcacggaatgacgcgatcccaatgcagttcctgatcagcaactgggaatttgaccggaagcgcccgtgtcttgtgcgataagtttgtttgtaaatattgtcatatccgctattttgtcttacaattgaacaactgaagggagagttgttcgtgtacgaaggtttagaggatttgaaagtcgatacagtcaatcggaaaacattagccaagcaggtcatcgaacggattgtccatttattatcgagcggacagttgagggccggagacaaattgccgacagaaatggaactgatggacattttgcatgtcagcaggccggtgctacgggaagcactcagttcacttgaaacgctgggcgtcattacgagaaaaacacgagggggcacatatttcaacgataaaatcggcatgcagccattttccgtcatgcttgccttggccactgataatcttccggctatcattgaagcgcggatggcgctagaactcggactcgtgacaattgccgcggaaaaaatcaatgaggaagagcttcagcgtttgcagaagacgatcgacgatattgccaacagcactgacaatcattatggtgaagcggataaagagttccatcgaattattgcgttaagcgccaataaccccgtcgttgaagggatgattcagtccctgctgatcacccatgcgaaaattgacagccaaattccgtacagggagagagatgtaacggtcgaatatcacaaaaaaatctacgacgcccttgccaaaagagatccgtacaaagcacattaccacatgtatgagcatctgaaatttgtccgtgacaaaattctaaaaggaatggatgaaaaataatggtgagcaaccgcagttgaaacgtaagagctgcggtttttttaaaccaatttagaaaacgcttactaaaatatgaggagtgattttcatatggcgatgaacctcaggaagaaccaagcccccctttacatcaaagtgcatgaaatagataacaccgcgattattgtaaatgatggaggactgccaaagggcactgttttctcatgcgggctcgtacttgaagaggatgttcctcaaggccataaggtggccctcaccgatctcaatcaaggggacgagatcgtgcgttacggagaggtgatcggatttgctgatgagacgatcaaacgcgggagctggatacgggaagccctcgtgagaatgcccgctcctccggcgttagacgatcttcctctcgcaaacagggtgccgcagccgcggccgtctcttgaaggctatacgtttgaaggatatcgaaatgcggatggcagtgcggggacaaaaaatattctcggcatcacgacaagtgttcaatgtgttgttggcgttttggattatgcagtcaaacgaataaaagaagagctgctgccgaaatacccaaatgtcgatgacgttgtgccgctgcatcatcaatacggatgcggagtggcaattaatgcgcccgacgctgtcattccgatccgcacaattcaaaatctcgcgaagcatccgaacttcggcggagaagtaatggtaatcggattgggatgtgaaaagctcctcccggaaagaattgcctccgaaaatgataatgacattctatcgctccaggatcatcgaggttttgcggcgatgatccaatccattttggaaatggcggaggaacggttaatcaggctgaacagcagaacccgggtgtcatgccctgtttcggatctggttatcggcctgcaatgcggcggcagtgatgcgttttccggcgtgacggcgaaccctgccgtggggtatgcggctgatttattggttcgcgcaggtgcaacggttttgttttctgaagtgacagaggtgcgggatgccattcatttattaacgccgcgggctgtcagtgaagaggtcggacaatcactgatcaaagagatgaagtggtatgacagctatcttcggcggggagacgcagaccgtagcgcaaacccgtcaccaggcaataaaaaaggcggattatccaatgtggtggaaaaagcgttaggctcggtagcgaaatcaggcacaagccccatctccggcgtgctcggccctggtgaaagagcagagcaaaaaggcctgctgttcgcggcgacaccggcaagcgattttgtgtgcggcaccctgcagctggctgcgggcatgaatctgcaggtgtttacgacagggaggggaacaccatatggcctggctgctgcgccggtgctgaaagtatcgactcggcattccttatcagagcattgggctgatttaatcgatatcaatgccggccgaatcgcgacaggagaggccagtatcgaagacgtaggctgggaaatcttcaggacgattttggatgtggcaagcagccgcaaacaaacgtgggcagaccgttggggtcttcataatgatttgtgcttgtttaatcctgctccagtgacttgattcatgtttttatagcggggagatggaatatgctgtaaaatgaaaatcagcgtataggaaacggaggggttacagcatggcattcatgagattccgagtgacacgaattcaatagtgaacaactctcggctgaaagcgggagaatcgggatgaatccgcctatgtatgagcccttaaaaggttatcaaaaaagagggtggcgtgcctgcccttttttgtgccttcaagcatcccttctctctactgcaggccggagcatgagaaaggggaaatgggatgacaaaccttaacaaaaaacagcttatcactgagattgtcgggcttgcacgcagccaaggtttgacggttcattctgagaacgcgcaattgaatgaaaccggaatggactttcaagttgtatttgccaaggacgacacaggtatgccatgggtgctgcgaaaaccgcggcgaagtgatgttgtggaaagagcatctgcagaaggcataacgcttgcctttctccgcgcgaatctgactgctgatgtgccggattggagaattcatacaccggaattgatcgcttaccccatgttaaaaggaacgccggctgctggaattgacttggaacaaaagcaatatgtatggaatatggatcatcagccgccgtcagacgactttgtccgcacacttgccgacatactggctgaattacatggcacggatcaaatatctgctgggcaatccggaatagaagtgataaggccagaagatttcaggcaaatgacagcagactctatggttgatgtgaagaataagcttggcgtatctacgacgctttgggaaagatggcaaaagtggataaatgatgatgcatactggccgggtttctcttctttgatacacggcgatctccacccgccgcatatccttatcgatcaaaatggacgtgtcacaggacttctggattggacagaagcgaaggttgctgacccagctaaggattttgttctttatcaaaccattttcggagaaaaagaaactgcccgtttgcttgaatactatgatcaagcaggcggccggaaatgggcaaaaatgcaggaacacatctcagagatgcaggcggcgtatccggtggaaatcgccaagctagctctgcaaacacagcaggaggaacacatcaatatggcgctggaagcacttggtgtaacatcggattaagaattgacttcgtttcatgaaccgagtattataaactctacaaataatagaacggatcaacaatcgtgaggaagagcaagtacgcatcagaatggaggttcagagagtcggtggcaggtgtgaaccgatccttccctgatgccgaatgggcttctgaattgctttgctgaacggatagtaggcgatgccgggtttctctccccgttaccaagagaggagtatcgaaacataggttttctgtacttagagtgaacggctgtatagctgttaataaaggtggtaccgcgagaccctcgtcctttgcataggacgggggttttttgtgtttcttaaaggaggtgacggccaatggacgatggctggtggtggcatagcagatgagttagaaaggaggatatcaaatggtcattgcaactgatgatcttgaggtcgcatgtcctaaatgtgaaagagcgggagaaatcgaaggaacaccttgcccggcctgcagcggaaaaggtgttattctgactgctcaaggatatacgcttctggattttatccaaaagcatttgaataagtaaaggagaaaagctgagctgagatgagggcagaagagcagagtaagattcgtgaggccgcagcaggtacgatttttttgctgatcggaacagtttgttttgcgtctaaatcgatttggataaaatgggcataccaaatgggtgctgagccagatgccgtgctgctatacaggcagctgctggctgttccgctgttttggctgatttttttaacataccgtcctccaatgccagacggtaagaaaaaaggagacctatggaaggcttgtggcgcgggagtgttttgtttttttctgtctcccttgcttgattttatcgggctgaaccatgtatccgcaatggttgaacgtatattgctgatgagctatccgttgtttgtgtttggattcgccgcgtgtcgtgaccggaaaatgtcctcaattcaggaccttttcgcagttctggcggtcatgtttgggcttttcttggcgctgggcggctggaatgctgagcttttccaggcgaatatgattggagctgtattcatttttttatcttcggcggtctatgctggttatcttgtcctttccgggcatctcgtccatcaaatcggggggatccgtctcaatgcatacgggatgacagctgctggagctgccatgatgctttacacagggataaaatcggcggctggcatgaatacgccaatggcagcatatccgctttctatgtatggtttgttcgcggtaattgcagtcgtaaccactgtgattccatttgtgctaatgcttgagggcataaaacgaatcggggcacagcgagccgccgccatttcaatggcagggcctatcctgacgattttctatggagctttatttctcggtgaacggcttcggcttattcaagtcattggatacactgctgtattctttgtcattacgggcatggaatacaggaagctgaaaacaggaaaaaaagaataatttatataaaacacacacgtttttcaattacaataagtgtaattacgtgtgtgttttttgattttgtaaaggttaggtgagaagatgcagcgcatattgcttgtagaagacgaccactcaatcagtgaaatggtggatcattatttaacaaaagaaggctttggaattgtgcatgctttcgacggagaagagggcatccggctgtttcagcaggattcatacgatttggtcctccttgatatcatgctcccgaagctgaacggaatggattttctgaaaatcatccgggaaaaaagcaatataccggtcttaatgatttcggcaaaagacggagatgtagacaaggcattgggactgggttttggggcggatgattatatcgccaaaccgttttctatgattgagctgacagccagagtaaaagccgcgatacggcgggcgacgcaatattcggcagaggagccggctgtgaataaggtgatccggattcaccagcttgcgatagatatagacaatgtttccgttttgaaaaacggagaaccgctccagctgacgtcaacagaatggcagctgctgtgcttattcgcatcaaatcctaaaaaagtgtttacgaaagaacaaatctaccgttccgtttggaatgaagagtactttgatgatcagaacatcattaacgtacatatgcggcggctcagagaaaagattgaggatgacccctcctcccctcaatatattaaaacgctatggggcatcggttataaattaggagagttttagaatgacagtgctatgggtggccgctgtcatcgctctggcgtgtctgaatgtgattcaattcataatgaaaaagaagcgggacgggaatctggcttacacggctgaccagcttagctacatgctcagccgggattcggcaggacaaattttgcttcctacagacgatcatgcgctcaaaggcttgcttgttaacatcaatcttatcgttgagaatcgtcagcagatcagcgcccaatttgccaaaacagagcaatccatgaagcggatgctgaccaatatgtcgcacgacctgaaaacgccgttaacggtcattctcggttatatcgaagccattcaaagtgacccgaacatgccggacgaagagcgggaaagattgctggggaagctccgccagaaaacgaatgaactcattcagatgatcaactccttttttgatttagcgaaattagaatctgaagataaagagatcccgatcaccaaagtacatatgaacgacatatgcaaacgaaatatcctgcactattatgacgctgttcagtcaaaaggctttcaagcagccatcgatataccggatacgccggtgtatgcgcaggcgaatgaagaggcactggacagaatcctgcaaaacctattatccaatgcgattcaatatggcgcggccggcaagttaatcggcatgacgctgtcttatgatgagaggaacatcgccatcaccgtatgggatcgcggaaaagggattagtgaaaccgatcagcagcgggtgtttgagaggctgtacacactggaagaatccagaaataaagcatttcaaggaagcggcctgggtttaaccatcacaaaacggcttacagaaaaaatgggaggcaccatatccgtccaaagcaagccgtacgaacggactgcatttacgatcacattgaaacgcatgacatattaatcgtaagaatttcttaaggtttgagaaataaaaatgacagggctcgccgctacaatagaaaacaggaaaagagagggaaggagaaacaaagttgacttatatcgtacaaacaaacgggctgaccaaaacgtatcagggcatagaggtcgtatccaatgtcagcatgcatattaaaaaaggtgaaatctatggctttctcggcccgaacggcgcggggaaaacaaccatcatgaaaatgctgacgagccttgtcaaaccgacaagcggtgaaatcatcattcttgggaacaagttcacccacacgtcatatgaggtgctggggaacatcggcagcatgattgaatatccgattttttatgaaaacctgacagctgaagaaaatttagatctgcattgtgaatatatgggataccacaataaaaaagccatacaagaagtgctggatatggtgaatttaaaacaaatcgacaaaaaacccgtcaaaaccttttccctcgggatgaagcagcgccttggaattgcgcgtgccatccttacaaagccggatctgcttattctggatgagccggtgaatgggcttgaccctctcggcattaaaaaaatcaggcaattgtttcaagtgctgagcaaagagtacgggatgacactgctgatctcaagccacctgctgggtgaaatcgaacaaatcgcggacacaatcggcgtcattcgggacggcagactgcttgaagaggtatcaatggaggatgtcaggggccagaacactgaatacatcgagcttgttacatcgaatcagacaaaggcctgctttgttcttgagaaagagctgcaattaaccaactttaaaattttaaatgagaaaacaatccgaatttacgaagccgaagcctcacaggctgctatatccaaagcgctgattttaaatgatgtagacattgaatcattgaacaaaaagtatacgtcgctggaggattattttatcaaattgatcaacggcaatagcatcagtgcgtaaaggaggagagacacgttgatgaatttgatcagaatcgaattaagaaaaatgaaaatgggctggtatattagaggtgcccttattgccaacgtgatcattatgggttttatgtggctgatcagttattccgaaaaagccgatggcggggtttcgttccaaagtacggatgaagcattcctcatcatcggtaccttcgtcagagcggtatttatcgtatttggcgctgtgctgatcgtaaaattggtgatttcggaatataaaaacaaaaccattcttgtgatgttcacgtacccgatcagccgtaaaaagctgctcaccgctaagctcatgatcgcgggcggactgacgtttatcacgattttactttcaaatatactcatagccgccggtttcttttggctgaactcgatctaccatttcataccgggagagcttacttccgagatcatttctcaacaggcggtcaaaatggcggttttcgcttttggcgccgctggaaccagtttagttcccatcttttttgggatgcgtagacactcggttccggcgaccatcatttcatctgtagtaattgtgatgctcatcagctcaacaagtccgggcttctcgatttcatctgttgtgtatatcccgttatcgttagcggcattcggattgttcttttcctacatggcgatcaggaatgcggacaagcaggatgcgtaaacaaaggcgcccaatatgtataaaaggccgatgctgtcagcaccggcctttccattatgagtctgttcttgtttcaagataatgcttcttgccaatctctttgctcatcatatagaaatggaagcaatattcaccgattgccatgacgatcgcgccgaataaagccgccaatgcaacttcaccgccagtcatccccatagaaagcggcatgcccatcagccagatcacgagaaaggccaaaccaaaatcagccaaagttgcaatcatattattccatttcggcaatacataaagatcgcccagtaaataagaaataacccctaacacaatcgtcattagcagcgtatcaccaaacgtgaacccaaagcccagaccaagcaccagatacaacacaataatcgtcataatacctttaatagcgagcgctttcacatgtgtcattacaattcctccttttgtcatttgatttgttatgtataattcctcaaatgtaaaaagttaaaccttattttttttcggaggcgggtgcaaatctgctggggaggggtcaatgatgtgaatccaggaattgaggctgcggcgcttcgacagcggaaatgtgaagcttgtactgcaccggacgctgctttgatgcccaacagcccattatgtttgctgtttttagatgaataaatttaaaaacttctcctgtccctccgtcatcacttcagaagtaatgaaatatgatgaaaagagatcaaggggaggtgacgtgatggcggtcgtgagagcaacgagtgcggatgtcgatttgatggcaaggctgctcagagcggaagcggaaggtgaaggcaagcaggggatgctgcttgtcggcaacgttggaattaatcggctgcgggcgaattgctcagattttaaaggcctccgcaccatcaggcagatgatttatcagccacacgcgtttgaggctgtgactcatggatatttttatcaaagagcgcgggatagcgagcgtgcccttgcacgccggtcgattaatggtgaaaggcgctggcctgcaaaatttagtttatggtatttcaggccggaggggactgtccagcccagtggtataaccagccgtttgtggccagatttaagtcacactgcttttatcagccgacggcggagacgtgtgaaaatgtatataacacattttagagacaggacaccgttcaagttgaacggtgtttttctttgaaaagatgcaatggaaaatattcctgtgagataatcgaagaaaaaagagctgacggagatgacagaatggcaacaattgacctgcaaaagaaaagtgtaaagatcgtactggagaaaaagcagttaacgaaggtgacggctcgtgtcggattggttcttgatattacgggatcgatgagaccgctctacaaaaacgggacggttcaaaatgtggtggagcggattttggcagtggctgatcagtttgatgataacggtttgctggatgtatgggtgtatgataatgaattttcccgattaaagccagtttcagaaaaggattttcgggctatgtcgatcgtgaaattttaaataatgaccgcttgcataaattcggcagaaatgatgagccgccagtcatgaaggacgtgctgcgcaaatatgttgcggaggaaccgagctcgtatcctgctttcattgtttttatcaatgacgggggctgtaaaaagtcaatcaaaccgataattgaagcttcttctgataaaccggtgttctggcagtttgtcggcatcggaaacggaaactttgattttctcaataaactggatacgttagaagggcgtgtcattgataacacgaatttcctgcatatcgaagagattgaccgcatttctgatgatgagctttatgatgctctgcttgctgaatttccattttggctgaaagaagcgaaggaaaaagggattgtaagagaacaagagcctcctgctgaaaagccgaaaaagaagggctttttcagcagattgttttcgaaataactgataaggcactgagccattctgcgaaatggctcggtgtttttgtttttttaagatcatgtgaagaaaaatagtccgaatgggcggcttgcaaacgacaggatatgcagaaaacgcgtcattcagccagctttcggcatgtttcagcggcaggcttgtgagggaagacctgtttttgatgttcagcgcttacaatcggttcacacttcttcacagtcgtttaacaatgatttcctataatggagacgatcaatgaggagagaggggatcttgaatggcatacgacagtcgttttgatgaatgggtacagaaactgaaagaggaaagctttcaaaacaatacgtttgaccgccgcaaatttattcaaggagcggggaagattgcaggactttctcttggattaacgattgcccagtcggttggggcctttgaagtaaatgctgcgcctaaattctcaagctatccgtttacattaggggtagcgtcaggtgatccgctttctgacagtgtcgtgctctggacgcgcctggcaccagatccgctgaacggcggaggaatgccgaagcaagccgtgcctgtcaaatgggaggtcgcaaaggatgagcatttccgcaaaatcgtaagaaaaggcactgaaatggctaaaccgagtcttgcccattctattcatgtggaagcagacgggcttgagccgaacaaagtgtactattaccgtttcaaaaccggacatgaactaagccctgtcggaaaaacaaaaacactgcctgcccctggcgccaatgtgccgcaaatgacctttgcatttgcttcctgtcagcaatatgagcacggatattatacggcctacaagcatatggcgaaggaaaagcttgatcttgtcttccatctcggtgattacatatatgaatacggcccaaatgaatatgtatcaaaaacaggcaatgtccgcacgcacagcagcgcggaaatcattacgctgcaagactatcggaaccgtcacgctcaataccgttctgacgccaatcttaaagctgcacatgcggcattcccttgggttgtaacttgggatgaccatgaagttgaaaacaactatgccaataaaatacctgaaaaaggacagtcggttgaagcattcgtgctccgccgcgcggcagcataccaggcatactatgaacatatgccgctccgcatttcctctttgccgaatggcccagatatgcagctgtaccggcactttacgtacggaaacctggcgtccttcaatgtgcttgatacccgccagtacagggacgaccaagccaataacgacggcaataagccgccttctgatgaatcgcgcaatccgaatcggaccctgcttggaaaagaacaggagcagtggctcttcaacaatttgggcagttcgacagcccactggaatgtgctggcgcagcagattttctttgccaagtggaatttcgggacaagcgcaagcccgatctacagcatggattcgtgggacggctacccggctcagcgcgaacgggttatcaattttattaaaagcaaaaatctgaataatgttgtcgtactgacaggtgatgtacacgcaagctgggcatcgaacttgcatgtcgatttcgagaagacaagttcaaaaatattcggagccgaatttgtcggaacctcgatcacttccggagggaacggcgccgataagcgagcggatacggaccaaattttaaaagaaaatccgcacatcaagttctttaacgactatcgcggatatgtccgctgtacagtgacgcctcaccagtggaaagccgattatcgggtgatgccgtttgtgaccgagccgggcgcatccatttccacgagggcttcattcgtttaccagaaagaccaaactgggttgagaaaggtatcatccacaacaatccaaggcggggtgaagcaatccgatgaggtcgaagaggatcgtttctttgcgcacaacaaagcccacgaaaaacaaatgattaagaagcgggcaaaaatcacgaattaaggagtggaaattatgttttcaaacattggaataccgggcttgattctgatctttgtcatcgccctcattatttttggcccttccaagctgccggaaatcgggcgtgctgccggacggacactgctggaatttaaaagcgccacaaaatcacttgtgtctggtgatgaaaaagaagagaaatcagctgagctgacagcggtaaagcaggacaaaaacgcgggctgaatgctgatgaggcagacaccgggtctgcctctttttttatgaaagggagggcttttttgaatggataaaaaagaaacccatctgatcgggcatttagaagagcttcgccgccggattatcgtcacccttgcggcattttttctatttctcatcacggcttttttgttcgtacaggacatttatgactggctgatcagggatttggatggaaagctggctgtgcttgggccgagtgaaatcctctgggtgtatatgatgctttccggcatttgtgccattgcggcttctatccctgttgccgcgtaccagctgtggcgtttcgttgcaccggcgctgacgaaaacggagcgcaaggtgacgctcatgtacataccaggtttatttgcgttgtttttggcgggcatctccttcggatactttgtcttgtttccgatcgtgctcagctttttgactcatttatcctccggccactttgaaacgatgtttacggctgaccgctactttaggtttatggtgaatttgagcctgccgttcggcttcttgtttgagatgcccttggtggtgatgtttttaacaaggctgggtatcttaaatccttacagactggccaaagcgagaaagctgtcctattttctgctgattgtcgtgtccatattgattacaccgcctgattttatttctgattttctcgtgatgatcccgcttcttgtcctgtttgaagtgagtgtcaccctatcggcgtttgtctataaaaagaggctgagggaagaaacagcggcggccgcttagtgcagtgtaccgcccggtgacttcacatcctcatcatattgtgcggccgtaacagcggcgattctcaatgcccggacaatcgtgtccaggctgaggctcggcgctgttttgtcgattgtttgctgcggaatgtaaggaatatgaataaaaccgccgcgaatgtgcggggatgtccggctaatgtgatccattaacccgtagaacaaatagttgcatacaaaggtccctgctgtgtaggaaaccgcagctggaatgccatgttccttcatcttagcagtcattcgtttcacgggaagccctgtccagtaagcggcgggcccatctggagaaatttcttcatcaatcggctgatgtccttcgttatcggggattcgcgcatctgcaaggttgatcgccactcgttccggtgtaatctgcatccgtcctcctgcttggccgacacaaattacgatatccggttgatgtttttgaatggcttggcgcagagtgtccagagcggatctaaagacagtaggaatttgttccgctgtaatgattgcctcatccgtctcgaagccattaagccgtttcgccgcttcccatgatggattgacggtttctttgtcaaaagggtcaaagccagtgatcagcactttttttctcattctcccatctcctttttcttttattctattgtttatttatgggtttttcatcaaaataatgtaaaggagtgaatcataatggagcatttgccgcagcagtatcgtcatttattcccaaccttgcagacgcatacgatgcttgccagctgttctcagagcgcattggcagagcctgtatcaagggcgatccaggattatcatgatagcctgctgtatatggggacgaactggaaagaagcgatcgaaaaaacagagtttgcgagaaacgagtttgcaaagctgatcggggctgaaccggatgaagtggcggttgtaccgtcagtttctgatgcgctggtttctgtagcatcgtccttaactgcaattggaaagaagcacgttgtatatacagatatggattttccggcggtgcctcatgtttggcaggcacactccgattataccgtatccgtcattccatcaatagacggcgtgctgctgcttgaacaatatgaaacgcatatttcggatgaaacagtactgacgtgtgttcctcacgttcattatcgtgacggctatgttcaggatataaaagcgattgccgagatttctcagagaaagggctctttattgtttgtagatgcttatcaatcagccgggcatattcccattgatgtgaaggaatggggcgtagatatgctggcagcaggcacccggaagtatttgctcggcataccgggtgtggcgtttctttatgtgagaaaggagctggctgacgcactgaagccgaaagcatcagcttggttcggaagagagagcggatttgatggggcttatgcaaaagacgcgcgccgttttcaaacgggcaccccagcttttatcagcgtatacgcagctgcagcggctttatcgctgctgaatcatatcggggtttctcatatcagggatcatgtgaaaacgatctgtgccgatgcagttcaatatgccgctgaaaaaggcctgcagctggcggcggcacaaggtggggatcagccgggcatggttgcgatccgggatgagcgggcatcggaaacggcggcgttgctgaagaagaaaaaagtgatttgcgcgccgcgggaaaaagttatccgtctcgcttcccatttttataatacgaaggaggaaatgcggcacgcgattgatgaaatcgcggcgaaaacgatccacaagtaaacataaaaaatcccctgaacattagccaggggcttttcatattaatgatctaccttcacgcgcttcataaagaaagcgccaattaaaccgataatggcaacaatcattgcaaacacaaatgcgtgctgtacacccgctgtcaaagcttgcgggatgactgccggatcggcagggtttttaactgtactcatataatcatgctggcctgcagccataatgctgaccgcaaccgctgttccgatagcgccggccatttgctgcagcgtgttcataatggcggtgccgtctggataaaattcacgcggcagttggtttaaaccgtttgtctgtgcaggcatcatgatcatagaaatcccgatcatcaagcaggtgtgcaggatgataatcagcacagctgttgaagtggtcgttacatttgagaagaaccatagtacaacggtgacaatcacaaatcccggaatgacaagccatttcggcccgtatttatcgaacaagcggcctgtaacaggggacataaatccatttaaaataccgcccggcaagagaacaagaccagatgcaaatgcagtcaggactaagccgccttgcagatacatcggcagaagcagcatagatgacagaatgaccatcatacaaatgaacaccatgatcacacccaaaataaacatcgggtatttgaacgcacggaggttcatcatcggctgcttcattgtcagctggcggattgaaaataggataaggccgacaacgccgacaatcagtgacacgataacagtcgggctggaccatccccggagccttcacccgcgttgctgaatccgaacacaatgccgccgaagccaatcgtcgacaggatgatagacaatacatcgattttcggctttgtcgtttcagatacattctgcatatatgcgataccgaacacaagcgccagcacaaggaatggaagagagatccagaaaatccagtgccagttgaggtgctccagaaccaatcctgagaaagttgggccgatggcgggcgcgaacataatgacaagaccgatcgttcccattgcggcgccccgtttatgaggcgggaaaatcaccaagattgtgttaaacattaggggcagtaaaagaccggttccaagtgcctgaacgatccttgctgctaataaaaacgagaagctcggcgcaagcgccgcgatcaaggttcctataattgaaaagattagtgacacggtaaaaagctgtcttgttgtgaaccactgcaacagcagtcctgaaacaggaacaaggataccgagtacaagcaggtagcccgtcgttaaccattggacggttgccgctgtaatgttcaattccttcataaggtcggttaacgcaatattcagtgctgtttcactgaacatgccgataaaaccggccaacagcaaggaaatcataatcggcatcactttgtattgctgagatgctttagctgttgtttccaaaattatttcccctctctatcaactgcatgtagtatgtcgttttttttatctcttcagcaggtcaggaatgcagctggagatatgaaggagcggcgtactgttttttgccgtcaaagataaaagaataccgccttcaatcatcgcgttaaccacagtgctggcttcttttgcacggctctcgctgcagccagtctgccgcagtttttcctcatatacagaggcccattctttgtaggcttcatgacaggcttcgcgcaacggttcgcttttcaatgacgtctcagccgctagcaagcccacaggcaagccttcaatgtcttccgtacatgaaaactggcaggagagctccttcaaaaaggcttgaatgccttccgctggatcggtgcaggcttccatgcagtccgcgattttctgacggatatactccttcatctcatttacggcttcgatcgcaagctgttctttacccccgggaaagtggtagtaaagagagcctttaggcgcaccgctttcctttataatctggttcagccccgtgccgtaatacccttgcagctgaaaaagccgggtagctgccgaaaggattttctcacgggaatctccataactcataacattcccaccttactgaattgcaatcaaaaatatagtgactggtctattatcttgattcaatcatcaattgtcaagaaaaattcattgtatgaaaagacaaaaaaagaaggatatgacaacaaaaaatactgagagaaaagctgactgatcttttgactgaatagataaaatgttcaatgattaatcatcatatggatgtaaggagagaaatagatgaaaaaacaacgaatgctcgtactttttaccgcactattgtttgtttttaccggatgttcacattctcctgaaacaaaagaatccccgaaagaaaaaacgcagacacaaaaagtctcttcggcttctgcctctgaaaaaaaaggtctgccaaacattagaattttagcgacaggaggcacgatagctggtgccgatcaatcgaaaacctcaacgactgaatataaagcaggtgttgtcggcgttgaatcactgatcgaggcagttccagaaatgaaagacattgcaaacgtcagcggcgagcagattgttaacgtcggcagcacaaatattgataataaaatattgctgaagctggcgaaacgcatcaaccacttgctcgcttcagatgatgtagacggaatcgtcgtgactcatggaacagatacattggaggaaaccgcttattttttgaatcttaccgtgaaaagtgataaaccggttgttattgtcggttcgatgagaccttccacagccatcagcgctgatgggccttctaacctgtacaatgcagtgaaagtggcaggtgcccctgaggcaaaagggaaagggacgcttgttgttcttaacgaccggattgcctcagcccgatatgtcaccaaaacaaacacaactacaacagatacatttaaatcagaagaaatgggcttcgtcggaacaattgcagatgatatcttttttaataatgagattacccgtaagcatacgaaggacacggatttctcggtttctaatcttgatgagctgccgcaggttgacattatctatggataccaaaatgacggaagctacctgtttgacgctgctgtaaaagccggagcaaaggggattgtatttgccggttctgggaacgggtctttatctgatgcagccgaaaaaggggcggacagcgcagtcaaaaaaggcgttacagtggtgcgctctacccgcacgggaaatggtgtcgtcacaccaaaccaagactatgcggaaaaggacctgctggcatcgaactctttaaaccccaaaaagcacggatgttgctgatgcttgcgcttaccaaaacaaatgatcctcaaaaaatccaagcttatttcaatgagtattgaagaaaagaaggcgaataagccttcttttttttggctttttaggaccaataatgacctctgaatcttaaaatttctttaaaaataagccaaaattaccctttacttaattaatttggtaacgtaatataattggagaatttgttacaaaaaaaggaggatattatgaaatttgtaaaaagaaggatcattgcacttgtaacaattttgatgctgtctgttacatcgctgtttgcgttgcagccgtcagtaaaagccgctgaacacaatccagtcgttatggttcacggcattggaggggcatcattcaattttgcgggaattaagagctatctcgtatctcagggctggtcgcgggacaagctgtatgcagttgatttttgggacaagacaggcacaaattataacaatggcccggtattgtcacgatttgtgcaaaaggttttagatgaaacgggtgcgaaaaaagtggatattgtcgctcacagtatggggggcgcgaacacactttactacataaaaaatctggacggcggaaataaagttgaaaacgtcgtgacgcttggcggcgccaaccgtttgacgacaggcaaggcgcttccgggaacagatccaaatcaaaagattttatacacatccatttacagcagtgccgatatgattgtcatgaattatttatcaagattagacggtgctagaaacgttcaaatccatggcgttggacacatcggccttctgtacagcagccaagtcaacagcctgattaaagaagggctgaacggcgggggccagaatacaaactaatgagataaataaccttgaagagtcctattcttcaaggttattctgcttttagcacaatggttttcgccgccatatcatgaacggtttgttttttcttcgtaaatgcggctgtcaaatagatcaggcgggagaatacatgcacccacgctatgatgtaacggacaatcgcctgtaggaaagaaattttcttgtgtgtttcgtccctcacgatttgcagcccgatgatttttttgcccagtgtgcccttccaatttgtcagcggcatcagcaaagggtacacaatcagcatcaatatggcgacaataatgacaccggcggacccatcgccaaacgtaaatccggctgccaaaatcactgctgcggcaatgattacatcaagtacaagcgcgcaggcgcgcagcatgaaaccagctagttccaatagaaacactccttaaaatgttaaataaatacctaatgattgtaaaaaagaagggcctatagtgggaataggtgataagccttaaatcacaaaagttggtgaaaatgtcataggtaaattggcataatcagccagcttattacattaccaaattcttttttagcccgaaaccaagccctcagaagttatttttgttaaaatagaaaagttacaacagaattcggagggtttattgtgggaaaagtgaaacgaaatgccccttgcccatgcggcagcggcaagaaatataaaaaatgctgcggaagtaaagttgtcgacttcccggcggaactagcggcaaaagaagcgaaacaaattcaggaagacttagtggagtatgccttcacagtacatagagaaagcatttcaggctttatcaaccagcatgattttctttctgctatggacagacagacgaaagacatcagcgtatttaacttaggaatctggggaatcttcttccacccgcttgctggtgagaagacaatcttcgaagagtaccttcagaaaaaaggcgattcgatcactcgtccgaaaacgcgtgagatcgtagaatcatggcagagcatgacgcctgctttattgctgctgaaggacctgaaggaaggcatcattcactttgaagatgtcattacggcaaaacaattcgaagtggaaatggacgccagcaatcaagaccttcctccagtgggaagcctgattcttggatacccaatccacgaagcggaaaaagcagaattcttcatgcagttcacgatcttcccggtgaagagaacagaagcgctgatcagcaaggtgaagaaatatgcggatgccgctgtgaaggacggcaaaacgccggaggacttcatgaagcaggaattcaacaacgttctgttcgcgttgttagctgagaaagatgaagagccacaagcagagaaagcggaagtaagcactgttgagtgggcaaacgacttggagaaagaaaccgctgcggctattgaagaaggcatgagcggggaagagtatccgactgaattgatcccagctgttattgacatctggaaaacattctgcgagaaaaaatcacctgtcatcagaaagccggaagcttttgctgcggcagttgaatattatgtaaacgcgatttctcttaacggcgcgtctgtttctcaagctaaactggcgaaaaaatacggcgtcagcgcatcaacgatttccagccgttacaaagaaattgaaagcacgctgcaagatgaagcagatcgttttgcacaagcgttatcctcataatgaaaaaaaccttgaaaagctgggcttttcaaggtttttttatttctgaaacggaattttgatttctaaccggaagatggggtggcggtaggtaaaatccagcctgccaaaagcgctcttcaccagtttttgaatgatatatgtgcccatgccttcatgagcgccgtttttcgttgagcggccaaacgattgatagattgtatcgagcacttttgggtccatcccgggagtgctgttttcacaagtcagtacataaagtccgctgcgcagtgaagtctccagtttaatctctgctttttctcgggcctccgccgcgctgtcgagcgcattttctaatatgttgccgaccaagctgacttgatcagcaggcgaaaacggaagggaagaaagcggtgtatgaatatgcagcgaaacactcacattcgaggcgcgggctttttctaaaaaatcataaagcacccctgcaacgtacgcgttctctcccttcaaaaatcggtcatattgactgtattgatccgcccagttttgaatatatgcttgtgtatctgccttgggctgagctgatttgattgcagtgatatgtttcattgtgtcatgattccggcttctgacatcaatcagcatttgattggcgtgctgttcagcttgagtcagcttatcaatttgatcggaaagccttgcctgcaaagcagactgtccgatacggagcccttcacaccctgcaaatatcgcgattacacataatgccggcatgatgtctgtgccgatcagcactactcccgccgacatcacttgaatcaccgcaatccacgcacaaagctggaaggaacagcagtcccacacccgcttcgtattccaaatgtacaatcctgcagcagctgcgcctaaaacagcggtgagccaagagactgctgtgctgtgtgaaagagcagcagctccctgataacatatgaaactaaataaaaccagataaagacattgaaaaagggtaatcacgttccgaactcctcaaaaatagtagttttgaaaataatcaagctgctgcttagtgatcatcgcttttttagacgttccctcaaaggaaactgtgaatgaatgcttggtataagcggaaaaatgctttatgtaatgaatgttgataataaaggaacgatgcgaacgaagaaaatccttttcgggcaggtcgcctttaatatcatttaatgtttgatacgtttgcacctcttcggcggttgtcacaatcgtcgtcgaacgtcccgtccgttctgcgaaaataatatccttcttttgcaggacgtgcatttcagacttttgctttatcaatatacgcccattcaaactcgtttccgttttctttttcaagtaccggtcgaaggaagcggccagacggtcggcatagtacggcttcataatataatcatggacgttcaggtcaaaggcgtgaaccgcataaccgtcgtggccggtaacaaaaatcacatccacatcaagtgaatgggatttgatcaaatcagcaagctcgtagccagacatatggggcatctcgatatcggcaagcagcagatcaatgtctccgttctttacccgcctgtaggcttccttcgctgaatcggtggaaaagacaatttcgacgtcctgcattctggaaacgatcgcttccagcttctctaaatctactcgataatcatctacaagtccgacttttaccattatcattcccctagttacatagaatcatctttattctatcccatttcgcgacataaaaagaactcttcgcgacaactttatccaactaatccagcttttcgtatatagtcattactagaaataaagataagggagattgtgacatgattacactgaccgattgcagccgcaggtttcaggataagaaaaaagtagtcaaagcggtgcgagatgtaagtttaacaattgaaaaaggagaagtcgtcggcattctcggagaaaacggtgccggcaaaacgacgatgctgagaatgattgcttccttgcttgaaccatcacagggtgtaatcacagtagacggctttgacacggtcaagcagccggctgaagtcaaaaaaagaatcggtgtcttattcggaggagaaaccgggctttacgacaggatgaccgctaaagaaaatctccaatacttcggcaggctgtatgggctgaaccgccacgagatcaaagcaagaatagaagatttatcgaaaaggttcggcatgcgcgattatatgaaccggagagtgggcgggttttcgaaaggcatgaggcagaaagtcgccattgccagagcgctgattcacgatccggacatcattttatttgatgagccgacaactgggcttgatattacgtcaagcaacatcttccgcgaatttatacagcagctgaaaagagaacaaaaaacgattcttttctccagccacattatggaggaagtgcaggcgctctgtgacagtgtcatcatgattcacagcggagaggtgatttaccgaggggcgcttgaatcactatacgagagcgagcgcagtgaggatttgaattacatctttatgtctaagcttgtcagggggatttcttaaatgctgagccatatttataaaaaagaaatgatcgacgctttgcgcgacagaaaaacgattttactcacaatcttagtgccgatgattatgatgcttggacttgtcttcttttatgaaagcatgctgtccgacaaaggggagcagtacacgctggctgtcggccattcgcttccgcccgcacttgaaagcaagcttaatgagattgacgaaatcagcgtaaaaacatttgcaaagcctgaagaggcagttgatgaaggaaaagcagatgcctatctgaacgtcccgaaagagttcgactcatatgtcaacagcatgacaccttttaaggttgatgtttacggcaattcaatcgatcaagggtcgtcaaatgccatgcagcttgtgcagtctgccttagatcagtacaaaaatgaaattgtgcagcaacgtttaacaaataagcatattgatcaatcggtgatccagccgtttacgattcagcaaaaggaagcggatgaggagaaagggacttccgctattatgctttccgccattctgcctatgctgattctgacttccattgtttccggcgcaatgccgatcgctcttgatatcatggccggtgaaaaggatcggaagtcgatcgaggcgctgctattaacgccagtcagcagaaacaaaatgctggtcggcaagtggcttgcggtttccacttttgccgtggcttcaggtgtattggctttggtgtttttgattttgtccaccgtgttatttaccgaaaatttaaaaacggccttccagctgggagatcatatgtggagtgtaatcggcgcttcagcgctaatcattgtgctctctgcattgctgatctctgcgatggagcttttcatcagcatcatgtccagctcggtaaaagaagcgcaaagttatatgtctctcgtcgtctttctgcctgtgttcccgatgtttttcatcttcagcaaggcaccgaaccaatttgacttatcatactttctcatcccgtttctgaacctgcatgcgttatttaaacagcttttattcgggatgattgacccggctgccattttgtctacggcgggaaccatcgccgtgctgatcgccatcttctttttactagccagagcctgcttcctgaaagacaaatgggttcttccaaaataaacttgcgaaaggagaaatacactttctcctttttgtatatcctgaaaaaagaaggaaaatagaaaaaggatatctaatacaaaaagtgaccctgcactatttttcatcaaaattggtttcaaaggagaaggaacaatggatcaaacacgtacactcggcaaaacgaagctgaaggtgaagcggatcggattcggcgcgaatgcggtcggcgggcataatctatttccaaatctaaatgatgaaacagggaaggatttagtgcgcacggcattggatggcggcgtcaactttatcgataccgcctttatatatggattggggcgatctgaagaattaataggcgaagtcgtacaggaacgcggcgtacggaatgagctcatcatcgccaccaaaggagctcataaagaagtgaacggcagcattgaattagacaatagccgggagtttcttcgcagcgaggtggagaagagcctgaagcggctgaaaacagattacattgatttgtattatgttcactttccggatggaaaaacacctcttgctgaagtggcgggcactttgaaagagctgaaggatgaggggaaaatcaaagcgatcggcgcttcgaacctcgattatcagcaattgcaggattttaatgctgacggctatttggaggtcttccaggccgaatattctctcatacagcgtgatgccgagaaagagcttcttccatactgtgaaaaacaaggcatctcctttattccttactttccgcttgcgtccggactgctgacaggaaaattcacgcaagacacagtctttgatgatttcagaaaggataaacctcaatttcagggtgaaacgtttatccacaatctcaaaaaagtaaataagctgaaagcagtagcggaggaaaaacaagcggatacggcacatgtcgccttggcgtggctgttaacgagaccggcgattgatgccattattccaggagctaaacgacctgagcaattacaggataacctgaaaaccttgaacattgaactgaccgaagatgaagtgaatttcatcagcgacattttcaaataaaaaaggaaatagcctccgaggctatttccttttggtgttttattctttgatgaatgcttcgactaattctgctgctctgtaatcatccatatcaagctgccattggtcgatgtcatttttcttcatttttacttcaactgttttttcagatgaagcaggtccaagctttttaaattcctcagggtagacttgaagcgcgtatttcactgcctcttcatagctggcactagagtttttactgtagtagtctttcactttgtcttcgatacggtctgaaagagaagatgcatctacaggtttaactgtggcttcaacaattgcttcgtctttagagattgaagtcgtttttgcctgaatggaagagtttttgcttaatccctctttaatgccgttcacgatattatcaagcgctttgctgtccgcatatgtgctggaaaggccggaagctgagagataaccgtctttggctgattcattaaaatcatttacaatttcatttttgttagcaccggtgattttttcgaaatcggcgttatctttgccgaaaagaaggacatcaacataagctgataacgcttttgcagaatcttggagcttatctgccgtcgccaggatttttttgtcttttccgtcaattttaaaagtaactgattttggctttttatcaccgtaagattccggcgtatagttgagctcgtattgcttgcctttatctacaacgaagaaaagatttccttcaacggatttgtcagcgttaatcgtgctgccttgaagcttttcgctatagtcttcagggtctgtgtcagacattttggtatcaccttgatacaatgtgaaatccatactgtctacattcagcgggtcttttcctgtgtttttcaccgcgacattgacttttaacacaagctggtcatctgaagtggacttatcatatttagacggaagagtataagagacatccttgattttgacttgagctatatctgagcttttttctgtttctgattctttcttctccgcgcttgttttgctgccggaacaagcagctgtaaacatcatcagcagaagaattaggaaaacagcgtacgtttttttctgaaacattcatttttcctcctcaaatggtttaggaaagggagtcttttgtctttgagaaatggatctttttgaatggattagcatcatataaccaaaaaaatcagttcttttctcacggttttcaccggattttctggaaactccgccctcctttgtcatgaatggacctataaaaagttacaacggaattaattttaagattattagcttttatattgaataggttcatcatcctatttttggtgaaaaatgttctggtaaaactggtaaactcagaaaactgtgtattttagactattactttttgattagttggagggaacttaagaaggatgaaaggggctgcctttgtgaagaaagaggaactgaaacaaaaagcactggaaatcggccgggtgccgacacacttaaaactggaaattgaagattatggcggtgatgacaaaagagcctgtttttgttggacagatcctcaggatgagaatatcggcattatcgtggaacttggaccggacggggagctggaatccctttcccgtgatattgagcctgaaagcggagaaaggctgtctgaggagaaactagaggatatcatgcgccaatttgtcgagactcatcatccgggggcactctctgcctttgttcgtgaagaaaatgaccgtgcatacggcgataaagtgagattttcatatgttcaaatggaggctgggcttcctctccccatgagcggatttatggctgatgtttccttatcaggtgagatcgtttacttccgctattacggcgaagcgggcagcatcatcaagccaaagaggctcgcggatgttgaagaggcacttgcctttatcaagaaggacgtggagttcgaccttttgtttgaggttctccatcgttctgtttacaaaaacggagatgatcagccgcatttggtgtatgagcctgaatgtagggccattaccgtacctgcggatttggttcaagaagaacaaggaggagttgatgatgacgataattacagggagcctgagagctttcctctccctttattcgagggcatccgcgaaaaggccgatcctgacagcatgattggtattgaaaatgggtttgtcaaagagcgggaagcggatttgggagatgggagaattggaatcgtttggcggaatccggatgaccctgtgtatcagccggcggataaaagcatggacagctggtttaagggacggactcatcaagtgctgaaaaccatctataacaaagaaaccggaaaactcgaaggcgtcatgtcatttatggaggaaaaagggccgctgacagtaactttggcagagtgcgaaaaaatcgcgcttcgctttctgtttgctttatttccgaatgccgatcaatattttaggatcagatacgatgaaaaggatgaagaagaaaacgcagtcgctggttttacatttgaagcgcattgtcacggggttccgatccgatttgggcagatcagaatttgtgtcagccgccagacagggtatatcaccgtttatatgggaccggatattgacccaaataagctggcaaccattgatcctgtgccggctatttcagttgaacaagccaagtctatcttttggcagcattttaaagttgagcttggctgggaaagagagtacggggatgatgaagaacacagctaccggctcgtctataagccggtgtatccgcgttttatcgatgcacatacaggagagcctgtcttcagcatatggtgaaacagccaaaagtcacgcaattgcctcagatatagaagagagtatgtgatgaaagtaacagaaagaatctcgaaaaacaatgacaataatagaaaaggacctttcttcactttaaaagaagaaaggtctttttatataataaacaggattctctttgtcgtagactctttgaaagggatgacttcattggttaataaacagctgaaaaagaaggcgcaggagatcggaaatgtaccgacgcattatgagcttgagatagaagattacgaccaaaagcaaaagaagaacgggcaggcatattttatctggaaggaccctaaagatccggaaaagcacattacagttgaacttagaaatgacggcgctttgctcaccttttcaacaactgtccgctccgagacagacaaacaacttccagatgccgagctgaagctgacggctcttcagtttgccgctgcccatcattccggcacatttatgaattttcattttcaaggcaaggaagaacggggggagcacatccggtttgtctataccaaaatggagctggggcttccgattcccaattcaggttttttaattgatatgacacgcagcggtcagattgtccactttctatattacggaaaagggcataaagctgaagttccgacggaatttgtagcaaaagagaaggttgtgtcccattacttaaacacaatgtcttttgagctgatgtacgatgtcattgatggcgaacaggaaccaaggcttgtttatgaaccgattctcccgggatacagctatcccgcagatgtagacgaaattgtgcccgaccagcatatcgcagatgaaagaatagaaaacacggcgccactgccgccgcttcagaacaaggaagaagttgatatatttgccttgctgggttttacctctgatatgcagaaagtcagtgaaagagactttggggaacaaattggaagcacgtggcgcaggggcgctgcgccggagcgtaaggatttaagcataggaagctattttgaaacgagaaataaaaacacaatcaaaatgaagacggataaaagaaccggaaaattaaaagcagcgctttcttttatggagcggcagaacaaccgccaatgctccacggaagaatgccaagagatagcgcttcaatttttgtatgccctctatccgagagcggctgagtttttcagggtgaatcccgtccgaattgatgaaagagggagagtccgcaaccatttttctgtctggtataaaggagtgccgctgcggttcggcgctgcccgcatcattgtcaatccggaaactgggttgattgacgcttttatggcgcctgatattgaacctgaacaattggaagcgataaatcacaggccggatgtttccgctgaagaagcgagagaagcatttttagccgcttttgatgtgaagctggaatggcagcctgactttactgcaggcagtgaccagcactacaaacttgtctataagccggtttacccttcctatattgatgcgcacataaggaaaaagaaaaggttgtgaggggtgtctagttaggaatcatctccaagtgggggtagtccttgaatcgtttccaatccccgccccattcgaaaccgagtgtcttagcgatctcgacaacctccagccaatctgatttttcgttttgattgccgtcatattccatatcccatatgatgcttccatcccttttttgaagggcgaaatcaatcgctaaaccatagttatgatacgattcccctcctcttgcataggtgacaatattccctttttttgtacgtccctgtttatataattcatcttgttccttaaaggacctgaatctttcagtaatgacgacggtaatgcctttattcgctgcagcggctttgagtgcatcggcattctgcttcacaatcggatgaagatccgaggggacaggcatgtcctgcaaggcgttttgagaatgccattcatgccgaatataactaaaacaaagatctagaagaaatagaatacataagataacaaagatttttgcgggtaacttcatatcggtctcactttctcaagatgtgctgaatgttaacgcttttaagtgattgactctctctaaaagcgaacagctatgataaaatataacataaatagtagcaggaggaaggaggcagaccgatgagagcaaagattccatcagaagaagtagcagtaaagctgaatgaatggtacaagctcattcgcgcatttgaagcagatcaagcagaagcgttaaagcaggagattgaatacgatttagaagatatggaagagaaccaggacttgcttttatatttttctttgatggaattccggcatcgaatcatgcttgataagctgatgccggtgaaagacagcgacaccaagcctccgttctctgatatgctgaacgaaattgaaagcaatcagcaaaaactcacgggcttattggaatattacttttattatttcagaggaatgtacgaattcaagcagaaaaatttcatattagcgattgaccattataaacatgccgaggaaaagctcgagtatgtcgaggatgagatcgaaaaagctgagtttctttttaaagtcgcagaagtgtattatcacatcaaacaaacgtatttttccatgaattatgcgagccaggcgcttgatatctatacgaaatatgaactatacggtcgccgccgggttcagtgtgaatttatcatcgccggaaatttgaccgatgtgtatcatcatgaaaaagcactgacccacttgtgcagcgctttagatcatgccaggcagcttgaagaagcgtacatgatcgccgctgcctattataatgtcggacactgtaagtacagtctgggtgattacaaagaagcggagggctatttcaaaacagccgccgccatttttgaggagcacaactttcagcaagctgttcaagctgtattttcactgacccatatctactgtaaagagggaaaatacgacaaagcagtagaggcgtatgaccgcgggataaagagcgcgtctgaatgggaggatgacatgtacttgacgaaattccgcctcattcatgagctgtatcttggaaacggtgacctgaacgtgcttacagaatgctttgacctgctggaatccaggcagcttcttgcagacgccgaagatctgctgcatgatacagcggaacgtttcaatcagctggaacattacgagtccgccgctttcttttaccgcaggctgatgaatattaaaaagaagcttgccgagcagcgttttcaataggaaatggcagagaactacaggttctctgctttttttgtgctgttttcaactcggaaaaacagggtattttccactgcatagtgagaaatcagaggaggatatcaagtatgtacaaagatttaaccggaaaaacagcgattgtgacagggtcttcaaaaggaatcgggaaagccattgcggaacggttcggacaggagaaaatgaatgttgttgtaaactaccacagcgacccgtctggagccgatgaaaccctggaaatcattaagcagaacggagggaaagccgtcgcagttgaggcggacgtgtcaaaagaagaggggattcaggcgctcttggacacagctttagagcatttcggcacgctcgatgtgatggtaaacaactctggttttaacggcgttgaggcgatgccgcatgagatgagtcttgaagattggcagagagtgattgatgtcaatgttaccggaacctttctgggagcgaaagcagcacttaaccacatgatgaaaaacaatatcaagggcaatgtgctgaatatctcaagtgttcatcagcagattccgcgccctgtcaacgttcagtattccacatccaaaggcggcatcaagatgatgacggaaacgctggcgctcaattatgcggataagggaatccgcgtcaatgcgatagcgcccggcaccattgccacagaatcaaatgttgatacgaaaaaggaagagagcaggcaaaaacaattgaaaaaaatcccgatgaaagccttcggaaagcctgaagaagtggcggcagcagcagcttggctcgtatctgaggaagcaagctatgtgaccggcgcaacacttttcgtcgacggcggaatgacactttatccgtctcagcttgaatagaacacaaaacagggggattgcgggatgaaaacggactggtggaaggatgcagtggtgtaccaaatttacccgagaagctttcaggacagcaatggagacggaattggggatttgcgggggattatttcccgtcttgactacataaaggagctcggggcagatgtgatttggatttgcccaatctatccttctccgaatgttgattacgggtatgatgtgacaaaccataaggcgattatggattcttacggaacaatggacgattttcaccagctgctggaccaggtgcatcagcggggattaaagctggtgatggactttgtgttaaatcacacctcggtcgagcatccgtggtttaaagaagcggagctggacaaaaacagcaaataccgcagctattattattggcgtcccggcacaaagaacggcccgccgacagactggctctcagactatggctgcccggtctggcaatacgaggagcacaccggagaatactatctccatatgaatgccgtcaaacaagctgatttaaactgggaaaatcccgaagttcgccaggcggtgtatgacatgatgaaattttggctcgataaaggggtcgacggtttgcgaattgatcagctccatctcatttctaagaaagaatatcttccttcgtatgaggactatatcaatcagcaggcagagccgaagccctttcagccaaatggcgaacgaatccatgactatttaaaagaaatgacagatgaagtgttttctcaatatgatgtcatgtctgtcggagaggtcggcagtgtcacaccggaagaaggcctgaaatatacgggaacagataagcatgagctgaatatgatttttcactttcagcatatggagcttgatcagcagcccggaaaagaacattgggatttgaagccccttgagctttctgatttaaaatcggttttgacaaaatggcaaaagaagcttgaacatcaaggctggaatacattgttttggtgcaaccacgaccagccccggattgtgtccagattcggagacgatggggaataccgcaaagcatcagcgaaaatgctggcagccgtactttattttatgaagggcacgccgtatatttatcagggagaagaaatcgggatgacaaacgcgccgttcacccggattgaagactacaaagatatccaaacgatcaatatgtatcataaacgggtgtttgaaaaaggctatgatccaaatgatgtgatgagatcgatcttagccaaaagccgggatcacgcccggaccccgatgcagtggaacagcggcaaaaatgccggatttactgacggcacgccttggctgaaggtcaacccgaacttcaccgcaatcaatgtggaggaagcgcagggagatcctgattctgtcttaatctattacaaaaagctgatcagcctgagaaagcagtatgctgacctcatgaaagggagctttgatcttttgcttccggacgatccgcagttgtttgtatacatgagagaaaacagtaaacagcagcttttgtcggtcaataatttttcaaaagagcaggctgtttttcagtggcctcagaactgcggcaaagctcaggcctcactgcttctcagcaattataacaacgatgatcttgctgatgaaatggtgttccagccttatgagagcagggtctatcttctggacaaaacaaactaatgattgaagtggcccggcatttttagccgggtttttttagtacatatattcgctctgcaggcgggaagaataaatgaaaatgaaatttattcttgcaaaacgtaatgacttcggtttattatgatataggattacaaaatcgttatcattttgatttaaagttactgaaaaagaggggatatacgatatgtttaaaaaatggagcggtttgtttgtgattgcagcgtgctttttattggttgcagcatgcggcaactcatcaacaaaagggtcggcggattcaaagggtgataaactgcacgttgtcacaacgttctacccgatgtatgaattcacaaaacaaattgtaaaagacaaaggcgatgtggatctgttaatcccatcttccgttgaaccgcatgattgggaaccgacgccgaaagacattgctaacattcaggatgctgatttgttcgtttataatagtgaatacatggagacatgggttccgtcagctgaaaaaagcatgggccaaggccatgccgttttcgttaatgcaagcaaaggtattgatttaatggaaggctctgaagaagaacacgaagagcatgatcatggggagcatgagcacagtcatgcaatggatcctcacgtatggctcagccctgttctggcacagaaggaagttaaaaatattacggcgcaaatcgtgaagcaggacccggataacaaagaatactatgagaaaaatagtaaagaatatattgcaaaactgcaggatcttgataaactatatcgtacaaccgcaaaaaaagcggagaaaaaagaatttatcacgcagcatacagcttttggctatctggcaaaagaatacggcttgaagcaggttccgattgcagggctttcacctgaccaagaaccgagcgcagccagcttggcaaagctgaaaacatatgccaaagaacataatgtaaaagtcatttactttgaagaaattgcatcctcaaaggtcgcagatacgctcgccagtgaaatcggcgcgaagacagaagtgctgaatacactggaaggcttgagcaaagaagaacaggataaaggtttagggtatatcgacattatgaaacaaaacctcgatgccctgaaagattcactattggttaaatcataagatagtgtgcgccggagggtgcacactatttctttgtgagaaaggaagattaacatgaatctcgtctcattgaaagatatcgttttcggctattcccatacgcctgttttagataaagtatcacttgatattgaaagcggtgagttcgtcggcatcactggaccaaacggcgcctctaaatcgacgctcataaaggtaatgctcggcatgctgaaaccgtgggaaggcacagtgacgatcagtaaaaggaatacagaagggaaacgcctgaccatagggtacgtcccgcagcaaatttcttcatttaatgccggctttccgagcacggtgctggagcttgttcagtcaggccgctatacaaaagggaaatggtttaaacgtttaaatgaagaagatcatcttgaagtagaaaaagcactgaaaatggtggaaatgtgggagctccgccatcgtaaaatcggtgatttatcaggcggacagaaacagaaaatctgtatcgccagaatgctcgccagcaacccggatctgctgatgctggacgaaccgacgacagctgttgattacgacagcagaaaaggattttacgaatttatgcatcacctcgtgaaaaatcacaatcgcacagttgtgatggttactcacgaacaaaacgaagtacagcaatttttagataaagtgattcgattagagagaggagaaaaaggcggatggaaatgtttgacttggaattcatgcgacgagcttttctagcaggcggcatgatcgccgtcatggctccgatactaggagtgtatctcgttctcagaagacaggccttaatggctgacacactttcacatatctcattgtcaggtgttgccatcggcttttttctcagcaccaatataaccgcagcaagcatagtcgtcgtgaccatcggcgcgatcggaattgaatacatgcggcgggcgtatcggacttattcagaagtgtccattgccatcttaatggcagctggtttgtccttcgcgatgtttttaatcagcctttccaaaggcacagccaatatgagcatcgatcaatacctatttggatcgcttgtgacagtaaaccagcagcaggtctatattatcagtattatcacactgctgatcctgctttattttatcgtactgagaaggccgctctacctgctgacgtttgatgaagcaacagccaaaacatcgggaatcaatacaaacgttctctcgttgtcattcagtattgtcacaggccttgcgatttcagtcattattccgatcatcggggtccttcttgtatcggccctgctcgtattgccggcagcattcgccatcagaattgcaaaaggctttaacatggttttcattacagccatactcatttcattattcagcgtatttacgggactgacatcatcctatcagctcgggacgccgccaggtccgtctattaccctgctattgatcgttttgctattaatcggatttgcagttcagggagtttggacgtttatcaaaaaagaagctcagcgcaaaaaaagaagccgataacatgaaaagcagttttccctagggaaaactgctttttttatagaaacaatccggcaaggcgctcataagattcctttttcgcctcaaaatcaaacacattgcacagaaccatgatttcatttgtttcgtagcggcctgtgaggtctaacagctgttgtttgacagtggttggagaaccgatcaccatccgctttctgttttcttctatgagttttttatcggacgctgtatagagatgggctttcgcttcctcgatgcttggcacgcggctgtccaagccttttccgacgcgaagaagccacaaatcctggcttaatgcgagttcttctgcctcttcatctgtttttgcgcaaatgacaaaaatcgtaaacagtgcggatggatttgaaaaatgggctgagggccgaaagctttcccggtagatgcggaatgcattttctcctcgctcgggattaatgaaatgcccaaatacatatccaatcccctgatgcgccgcgcgtcttgcgctgttttcaccaagaccgagcacccatagctcgggtgccgtaccaataaggggcgccgctttgattccggcatacggatggtcgggaggaagggaatctgttagaaaataagagacatcctgcagctgtctgttaaattcggttaagctttttttcaccccgtccgttaatgcaagcctggtttttgtcgtgccgccgggggaacgaccgacgccgaggtcaatccggtttggatacagggcctcaagctggcgaaaggtttcagccactttaaatgggctgtattggggcagaagcacgccgcctgatccgacacgaatggtgtttgtctgtgctgcgatgcgggcgatcatgatttcaggcgctgtgcttgccagtcctttcgtgctgtgatgctcggcaaaccaataacgcttatagccccactcttcgctaaatcgagcaagctcaaccgaatgctgaagagttgtcacagggctctctcctttagaaacaggtgcctgatcaagtatgcttaaatgaatcaaaaggccgcttcctttctgtctgtttttagatggtgacaccagaataggcaaaatgacttgcccgcgtcaaatggtttgtttaagaagcgcactttatagcatttgcaaatcatatatcaaatatggaagttttttttcgaggtttttcgtcaattattcttaacttttacgaaactttgatataataacaaacgtatatattagtaatttacggcttattttccttgtgagcgtaaaaataaatgtgactatcttcacatttcgatgagtaggagtgaatcgtgtggcaatttctttagaaaaaggtcaacgaattgatttaacaaaaggaaaagccggtctgtcaaaattgatggtcggtctcggctgggacccagtgtcctcaggtggagggttcttcagcaaactgcttggcggaggcggtccgaatatcgactgtgacgcttcagtgctgatgttggaaaacggaaaattcaccgataagaaaaacctgatttatttcggcaacctgaaaagccgctgcggcggtgtacagcatacaggcgacaacctgacgggtgacggtgcgggcgatgacgagcaaattatgatagatttagataaagtgcctggaaacatcgataagcttgtatttgtagtgaacatttacgattgtgtcagaagaaaacaagatttcggcatgattcaaaatgcgtttatccgcgtagttgatcaatctaatcacgaggaaatgctcaagtacaatttgagagacaattacgccggcagaacaagcctgattacagcagaaatctaccgcagcggcagtgagtggaagtttgcggcgatcggtgaaggcacaaacgatacgagattagaagatattatcagccgatacgtataaaagaaaaggagtggatgaaacatgacaatttcattggcaaaaggacaaaaagtagatttaacaaaaacaaatccgggtctttcaaaggttgttgtcggtttaggctgggatacgaacaagtatgacggcggacacgactttgatcttgactcaagtgtgtttctgttagacgccgcaggcaaatgcgcgtcaccaaacgactttattttctacaaccagcttgaaggcggcaacggttcagtcgttcattcaggcgacaacctgactggtgctggcgaaggcgacgatgagaatgtaaaagtaaatctcagcgctgtaccggcaaacattgataaaatctcatttgttattaccattcacgatgcagaagcgcgcagccaaaactttggacaagtatcaaacgcgtttgtccgcatcgtaaatgaagaaacaaatgaagagctcatccgttacgatcttgcagaagatttctctattgaaacggcaatcattgcaggggagctttacagacataacggcgagtggaaattctccgcaatcggctcaggctaccaaggcggccttgcccgcattgcaacagactacggtttgcaagtcggttaagacaaatacgaagagcagaaaggagagaggcagtatggccattcaattatcaaaaggacagcgcattgatttaacaaaaacaaatccgggactgacaaaagcggtgatcggcttaggctgggatacaaacaagtactccggtggacacgattttgacctggatgcttcggcctttttagttgatgcgcatgataactgcgtaaatgatctcgatttcgtcttctataataaccttgaacatccgagcggcggtgtcatccatacgggtgacaaccgcacgggtgagggcgacggagatgatgagcagattatcgttgatttctcaaaaatcccggctcacattgagaaaatcggcatcacagtgaccattcacgacgctgaagcacgcagccaaaactttggacaagtttccaatgcatttgtccgcgttgtggatgaagaaacgcagaatgagcttcttcgcttcgatttgggagaagacttctccattgaaacagctgttgtcgtttgtgagctttacagacacggcggtgagtggaaattcaatgcgatcggcagcggattttccggcgggctggctgcattgtgccggaattacggtttgcaagtgtaagcgagtgacaaatagagaagtcaccgtttcaaattaataggaggaaaaaacttggactttttacatcatattttgtctacgtatgcttcatttttcgattggaaaatgtgggggaagttctgactgatcctgtttcctggggtttgatcggttcccttgttgttctggaaggccttttatcggccgataacgcgcttgttcttgcggtcatggttaaacacctgccggaaaaacagcggaaaaaagcgttaacgtatggtttgtttggagcttatattttcaggtttattttcatcgggctcggtatgcttctcattaaattctggtggatcaaggtgcttggcgcgctttacctggcttggctcgtcattaagcacttctggataggcgaaaaagaagaggaagcggacggcatgaagaaaaactcttggatggtccgcacgttcgggatcttctgggcgactgtcatttcagtagaattaatggatcttgccttctctgtggacagcatcctagccgcgtttgcagtatctgaaaaagtatgggtgcttctgatcggcggtatgcttggtattttaatgatgcgtacagtggcaaaagtgttccttgtgctgattgataaaattcctgagctggaaaacacagcattcgtgttaatcggcattatcgcgctgaaaatggcggggagcgctttccattacgaaatgccgcactctgtattcttcattatcattatcgctgcatttgcggtaacattgatcattcactacatcaataaacaaaagcaggtgcgcgaacaaacagccgcttcaaaagaagaataaaacaaaacaaggagggaggttcaatgtccttccttttttgttaccgaaatatcgttcaatgacaaaccggaaaggaggatatgatgagacaagaagaactaaccattcataaagcacttccggctgatggcgattggaaaagcctgctgtttcagccattgccggagcgggatcactatgaaactgcacaaggcctttctttttctcgtcttgccggtcagatattgggcacgcctattgatgagacggactactataacgagctatatgagctgtctgtaaacgaccgcataacgattttgagtgaaacgctcgataaaacaatcgaaccggaaacatttcaaaagcttcagcatattcattccatcaatcagaaagaaaaagggctgtcagtcagccgctttgttgcctttctggacggggaaaagctgattgcgaagcactcaaatcccctgatgcaccgccatttaagaaaagcgctgatgacgcttttacatacctttgcggacagtcatgaaaaggggctgaatcatcctgattttcgcagagtgctgcttgatgtctcgaagttttccttaaaccatctgaacccttggctggaaaaaaccgatatagagcgggagatgccgaaggttgtttggtatggagatgcgacgaaaagccagctctatttcttatattatctgatgctagtcggctgtgatgtactactgttccatccggcgggaacggatcagctggcgcttgtcgacccgaagcaggagctcagttttacggaaaagctcccggatgtttcggagcttcagccgtttccgaaagaaaaaccagaccggaaatcaacagtggcttaccgctcaacaaaggaaattgaacatgtgctgaatcacgaggaatccatgctgtataagccgtggcagttcagagatcacacaccggtgtccgttacgctgaaaacgacctatgatgaattgtttttaatcacgaaagaacgcgcctttattcggccgaatttcaaagctgataaacattccattgagattccgaatgtattcgccaaaattatgggcgtgtcgaaagacaataaggaatattggaacaggcttcatactctagcggattatcaggaaacagaaatggtcagaagctttccatttacagaagaaataaagtcgaactatcaatttcactacagccacgcacttgatcaagaagggaacattgatccggacaagctgatggcaagcaatgtgtggcagtacaaacagctgccggcgggcgttcagactgccattgccaaaacgatttcgagaatgtgcaggcacccgcggcttaaagctttgcatcaggaacaagtcaaggatgttcaaatctatttgtttaaacaaacaacaaacctgcctgctaatctgctgaaattgattcaaatgttcgactatgcgcaaaccgttccgaaactcgttttatatcatacggaaatgagcggcggactcacgcgttcggatgctgctgccctgctgttcctgaatgaaatcggaatcgatatcatcatttataatccgcccggacaccaggatattgagcagtttattgaagaggaccagtatgatatccactggctggatgacatggtgtttcagcaggactacaaagagccttcgcttgtgaaaaggctcttcagaaccattacccaaaaataaggagagaagaaaagcatgacaacagaaaatcaaaatccgcttgttctcgataaaaatgaagagatttcccagcaaaaagctgacgatatccgtcttcagctccgtcaggaaccagaagtgaagcggcttgctcaacaaattgacgtcaaaaaccaaatggagctgcttgagtacggcaaggagccggccgttgaaatatccaagttctctgaccgcatcctagggatgatgaaaacaacaagcgtgacagactccggcacaatgctgactcagcttgggaaaatcatggaccgcttcgacaaaaatgattttgatgagccaaagggattaatggcgaaaattttcaaacgcggcggcagcatgattgaaaaaatctttaaaaagtatcagacacttggcggagagattgaaaaaatccacgttgagatttcaaaatacaaagatgagatgacgaagacgaactacacgctcgatgaaatgtatgaaaacaatatcaaatactatatggagcttgaaaaatacgtcgttgccgggcagatgaaactggaagagatgcagtcgatccttccttcatatgaggaaaaagcggcaagcgggaaccagctggcgcaaatgcagctcgatacgttgcgcaacggcattcaggcgcttgaggaacgggtgtatgatctggacatggcacggatggtggcgcttcaaaccgcacctcaaatccgtctcctgcagcgaggaaatgcaaagctgatcgggaaaatcaactccgcgtttatcattaccattccgattttcaaaaacggcattattcaggctgttacggtaaagcggcaaaagcttgtggctgattccatgagcgagcttgaccgccggacaaacgagatgctgaaacgaaatgctgaaaacatctcgagccaaagtgttgaaattgccagaatggccggcagaccgagcatagatattgaaacgatcgaatcgtcttggaacacgattgtcagcggcatgcaggaaacaaaacaaatcgaggaagaaaacaaacgcctccgcgaagacggcgcgagacgaattgcacagcttcaggataatattaaaaaagcagcattgcagcaataataaaaaccccgcttgtggaacataagcggggtttttcaattacatcatttagttaatgacaatgtgtaaagacaggtgtaaacttaaacggtaatcattttgcatatcagaggtgttggcaatgggaaaacaacagcctatatcccagcgtaaactgctgggcgtcgccggtttggggtggctgtttgatgcaatggatgtcggaatattatcgtttattatcgccgcgctccatgtagagtggaatctgtcgcccgaagaaatgaaatggatcggaagcgtcaattccatcggcatggctgcgggtgcgtttttgtttggtttgcttgctgatcgaatcggccgcaaaaaagtgttcatcatcacccttttatgcttttccatcggaagcggcatttccgcttttgtgacgagcttatcggcatttctaatccttcgtttcgtgattggtatgggacttggcggcgagcttccagtcgcttcaacactcgtttcggaagcggttgtgcctgaaaagcggggcagagtgattgtgcttttggaaagcttttgggccgtgggctggctcgcagcggccttgatttcttactttgtgataacaagctttggctggcaggctgccctgctgttaactgcgctgactgctttttatgcgctgtacctgcggacgagtttgcctgattcgccgaaatatgaatcgctttctgccaaaaagaggtcggtgtgggagaatgtaaaaagcgtctgggcaagacagtatatacggccgacggtgatgctgtcgatcgtttggttctgtgtggtgttttcttattacggcatgttcctatggctcccgagtgtcatgctgctgaaaggcttcagcatgattcaaagctttgaatatgtcctgctgatgacgcttgctcagctaccgggctatttctctgccgcatggctgattgaaaaagcgggccggaagtggatactcgtcatttacttgattggtacagcaggaagcgcctatttcttcggaacggcggattccttaagtcttctgcttacggctgggatgctgttatcgtttttcaatctcggtgcgtggggcgtgctgtatgcttataccccggagcaatacccgactgcgattcgagcaacaggttcaggaacgacagcagcgtttggaagaatcggcggcatcttcgggcctttgctcgtcggaacgctggcagcccgtcatatttcgttttcggtcatcttttcaatcttttgcattgcaatcttactcgcggttgcttgtattttgattatgggaaaagaaacgaaacaaactgagctagaataggaaaagcacctcttaaaagaggtgctttcagcgtgtcgacaaaccctcgcattcgttgtcaggactgcgcttcggtgctcaatgcgaagtggatcaacggctaaattctcaggcgtcctgcctaaacgccgtcgtcatcacatcctgtgaatgtccgctcctatgctcgtccttcctagacttcaagggttttcaatcacgctgaaaagatgacaaaatcctaaaatgaaaaccattttaggattttgtcaacaatctcaggcacctcttgaatgaggtgcttttttttacatttgcgcccgggctgcggattggcgtttcccggttttactaattgtctggtagagcgtcatagaaagtatgaacagaatggcagtaaatcctgtgacagctccgaaatgctgtgtgctttgatataaaaaacctgcaatacttgtaccgacagtggttccggcatacatagcggcattggaaagggaagcgatggtgcctcgcgcatttactgcaatggattgaaagacacccatcattaacggaaagatgatgccagctgtaaaaaacgtgagaaaaaagctggcttctactaaaaacaagtttggaaagaacggaagagcgaaatagagagcgcccattagcagcatcccgctgatcagtgttttaaacatgcccagcttttctgaaacccggctgccgataaggctcccgagcatatttcccagtccgagtacaagcatagctgcgccaatttgtgacacggttaaatgataatccgcggaaagccaagcacccagaaagctgaacgaagcgaagtttccggtttgaaacagaaaataggcaagcagaatgaccgatgttttcggcaatgaaaaaagctcccgataggggttgacaattgatggtcgcgccaatggttcagaaggccggatatcaggcatgaccgccgccaggatcaatagtagaataagcgagcatgttgacaaaacgaaaaatggcgtatgccatgtaaaggaagcgagaaaccctccaataggaagtccgagcatttgtgaagcggccaaacctgctgtcgcaatccccatgccttttatgatctgagaaggccggacaatgactgggatggacgcccaaatttgaggcgtcacaaacgcagcgctaacgcctgcggcaaaacggaacaggcacatggcggcaaaagagggagcgatgccgcataaaaacgtggatacgataaagcctgcaagtccccacagcatgactgttttcctgttcagccggtctgagattgggcctgcaatgaaagcgaagagcgcataaccgagtgcataagcactgaccatccagcctgacaaatcagtagagacatgaaactgattctgtaaaagggggagaagcggcgaaagcaaaaaggtatccgtgccaatgacaaacatgacactgaagaaaagccaaatgcgattcaaattttatcactcttattgttttataactttgaaactatgaaacagatatgtatagagaaaaccctttgttagagggtttccaaaaagccaggcaggtatgtttgaaatgtgtcttcacgcagactgacgtattttgtccgcgaatctttccgggttgccgtcaatcccgcttcacgcagcgttttaaaatgataagatgccgtggttttgacaatattgcacttttcacctacttcaccgcagctgagttcttttccgctgacataaagcgtacgaataatggcaagccttgattcatcagacagtgctttaaaaatttgcgctctgatttgatcatctgattgtttcatagtcatgaaactataatacataatgggtgttggaaaagcaacttatttttccagtaaaggagcaggaagtcataagaggaaggaggaattcaattccaataaaagcgttttcaactaaagataggagaaaaatcacccgtaaaatacaatcatataggaggattacagagcatttagaagcataaataagatcatgtggtcacatggatgtttataaagaaatggtacagaataaaagagaatatgctgtttgtgtgggaagttacataaatgttacggtaataaagattgcttaatatggagggaaaatatgagtgtagatgagaaaccaattaagataaaagtcgagaaagtctctaagatttttgggaaacaaacaaagaaggcagttcaaatgcttgccaacggaaagacaaaaaaagagatcctgaaagcaaccggatcaaccgttggtgttaatcaggcagattttgaagtatatgatggtgagatatttgtcatcatgggtctatcagggagcggtaaatcaactttagtacggatgttaaaccggcttattgaaccgactgccggaaatatttacattgatggtgacatgataacaaatatgtctaaagaccagctccgggaagtccgccggaagaaaatcagcatggtcttccaaaagttcgctctgttcccgcacagaacgatacttgaaaacacagaatacggactggagcttcaaggtgtagacaaacaagagcggcagcaaaaagcgcttgagtctcttaagctcgttggactggaaggatttgaacaccaatatccagaccagctttccggcgggatgcagcagcgtgtcggccttgcccgcgcgttgacaaatgatccggacatccttctgatggacgaagcgttcagtgcgctcgatccactgattcgtaaagatatgcaggatgagcttcttgatcttcacgataatgtcggaaaaacaattatctttattacgcatgacttggacgaagcgttgcggatcggcgacagaattgtcctaatgaaggacggcaacatcgttcaaatcggcacgcctgaagaaatcctgatgaatccatctaacgaatatgttgagaaattcgtcgaagatgttgatttgtctaaagtcctcacagcaggccacattatgaaacgcgctgaaacagtgcggattgataaagggcctcgcgtagcattgacactgatgaaaaaccttggaatttcttcaatttatgcagtggataaacaaaagaaattattaggtgttatctatgcgtctgatgcgaaaaaagcggctgagtctgatttgtcacttcaagacatcttgaatacagaatttacgactgtaccagagaatacgtatctgactgagatttttgacgttgtgtccgatgcgaatattccaattgcggttgtggatgagaagcaaagaatgaaaggaattgtcgtaagaggcgcgctgattggcgcacttgccggcaataacgagtatatcaatgctgaaggcactaacgaacaaacacaagatccttctgcacaggaggtgaaataagatggatagactgcctagaatacctttagcagatattattgaccgttttgttgactggattacgatgacgtttggcggattcttcgacggaatcgctaacggattggccgcttttgtaaatggaattgtcaccggtcttggatttattccatctattttgttaacgattattttcgccgcacttgcgtggtggatcagtacaaggggaattgcgttatttacgttgattggattcctcctgatcgattatttaggatattgggacccaatgctgcaaacattggcgcttgtgttgacatctgtgattatttcgattgtggtcggggttccgatcggaatttgggcgtctcagaaagaaacggttcgccgtattgtaacgccaattcttgatttaatgcagacaatgcctgctttcgtatatctattgccggcgattttcttctttaacatcggtgttgtgccgggtgttgttgcatctgttatcttcgcgatgccgccgacaatccgcatgactgttctcggtattaaacaagtgccggcggatttgattgaagcgactgaggcattcggttctacaacagctcagcgtttgtttaaagttcagcttccgcttgcgacaaaaacgattttggccggaattaaccagagcatcatgcttgcgttatcaatggttgttatcgccgcaatggtcggtgcaccgggacttggttctgaagtatacagtgccgttacacagctgaaaaccggggtcggagtagaggccggtatcgccatcgttatcgttgccattaccctggaccgtattactcaaaatattaaagtgaagaagaaaagcagggggaatgcctgatgcttaaaaaaatcatcggcatcggcgtttccgccatgctggcgctctcacttgcggcttgcggttcagaaaacgatgaaaatgcatccgcagcagaacaagtgaataagaccatcatcgggattgaccccggttcagggattatgtccctgactgacaaagcgatgaaggattatgacctgaatgactggacattgatttcagcgtcaagtgctgcgatgaccgctacgcttaaaaagtcatacgaccgtaagaaaccgattatcattacaggatggacaccgcactggatgttctccagatataagctgaaatatctcgatgatccgaaacaatcttatggcagcgcagaggaaatccatacgatcacacgcaaaggcttcagcaaagagcagccgaatgccgcaaagcttctgagccagtttaaatggacgcaggacgaaatgggcgaaatcatgatcaaggtggaagaaggcgagaaacctgccaaagttgctgctgagtacgtcaataaacacaaggatcagattgccgaatggacaaaaggcgttcaaaaggtgaagggagacaaaatcaaccttgcctatgtggcgtgggacagtgagattgcaagtacaaacgtcataggcaaagtcttagaagacttgggctatgaggtaacacttactcaggtagaggctgggccgatgtggactgcaattgcgacgggaagtgcggatgcatccctttccgcatggctgccgaatacccataaagcatacgccgctaaatataaaggcaaatatgatgatattggcaccagtatgactggtgtgaagatggggcttgttgttcctcaatatatgaaaaatgtcaactcaattgaagatttgaagaagtaatgaaaaaagcagcctggctacaggctgctttttttgcgttaagaagcgttagcggcagcaagtgattccgccttctgaaatgttttgagcacggcgttcgctaaaatatgaatgccggtaaacatcgcgtttctgtcaaaggtcatgtgcggatgatggagccccggctggagcccgcagcctagtccgagcatcgttgttttcagattcggcaccttcacggcgtaaaaatggaaatcctctccgccggtggtgacaagcgggtcatcaagccgctcagccccgatgatatctgtaatggcttctgccatgatcgcttcagcttctttgttttgtgttgccgcaggaaggctgtgttctttttgcagctcgattttggcgctgaatgcggcggcggccgcttcacaggctctttctgtttcggcgattaacgcctccatggcttcattggtctgtgcgcgcaaatcaaggctgaacgatgcttttcctggaatgatgttagagctttcaccgccggcttgaagttttgtcattttgacggtatgcgggatttgcgggtcaatatgaatgagtccgagcttatgtacaagaaatgccgcaatttcaatgctgtttttcccgaggtgcggacgggcgccatgagcctcttccccgatgatcgttccctcaatgtgctggcttgatccgtgcagaatagacggagcgcagcggccgttctgtgtttcctgaatcggacggacgtgaacgccatacaaatagtcgatatcatcaagcacgccttcttctatcattttcaaggcgccgccgcctttttcttctgccggctgaaagataaaacggattgtgcccttcggaagctcaggttgttttttgagcagcattaacgtgcccaatgccattgtcatatgtgaatcgtgtccgcaggaatggttggcgcgaaatgtgccgttaacctcctgccacagcgcgtcaatatcagcgcgtaccgctacaacaggtgagcctgagccgatttcaccgacaaccccggtgcagtctgaaaacgtgcgcgtccggcaccctaaatcctcaagcttttgtttcaaaaatgaagttgtctcatattccttccagctgacttcagggttcgcgtgcagatgttcgaagatgtccataatggtttgtttcatgtcttttgaaagcttttgcatggttagaaattcctccttctatcagaatgaatttttaccttctttactttatttatattgaaacaggaagataggctgtatataatatagcacatattgcaacttttcagaataataaatatattcaaacagaggggatggatcgaacatgagtatgccagcagccgaaacacagcctaagaaaaaacgaacgacatttaaaatgcctgacgcctatgtcctcttatttatcattgctttcatttgcgccgttgcttcatatgttgtgccggcgggagaatttgaccgcgtaacaaagggagatattacgactgcggtgccgggaagctatcattcaattgaacagtctccggtcagcttgatcagcttttttacttctctacaggatggaatggttggatcagcgccaatcatctttctgattttattcacaggcggcaccattgccattttagaaaaaacgggagccatcaacggactgatttacaatgtcatcagcaagttccgcacaaagcaattattatttatttgtattgtcggcgcattgttctccattctcggaacaaccgggattgtcgtgaattcagttatcggttttatccccatcggcctcattgtggcacgatccttaaaatgggacgcagtcgcgggagccgctgttatatacatcggctgctacgctggatttaactccaccatattatcaccgtcaccgctcggtttatcacaatcaatcgcggagctccctcttttctcaggaatcggcctgcgagttgtgatatacatatgctttttgctgtcttctattatttatatctatttgtatacgagaaaattaaaaaaatcaaaagatgccagtgtgttaggaacagattggttccctgcggcaggaatgggtgaagccggtaaagaagaagatcagtcagtgccgtttaccgttcgccataagctgattttggctgtggcgggactctcacttgtcggatttttatacggcgctttgaagcttggctggtcagattcccaaatggctgcgacatttatttttatttctgtccttgccggtttaataggcggacttgcggcgaacgatattgccaaaaccttcattacgggctgccaaagtcttgtatacggggcgctgattgtcgggatggcacgaagcatttccgttatccttgaaaatggaaagcttctcgatactgtcgtcaatgctttggcttcaattttggacggattcagcccgattgccggggcaatcggcatgtatatcgccagtgcgctgcttcattttctcatctcttcaggttctggcgaagccgttgtatttattccaatcctggcgccgctcgctgatttgatgggaatcacgagacaggttgcggttgaggcggttatgcttggagaaggggtcgtcaactgtgtgaacccgacatccggcgttctcatggcggtgcttgccgccagcggtattccgtatgtcaagtggctgcggtttatggtgccgcttgctctgatttggttcttgatcgggcttgtctttatcgtgatcggcgtcatgatcaattgggggccgttttaacgattgctgcccgccggcttgtacggcgggcttttgagttattcattgcagaagcgcaggctgttattgtaacatgtaagccataagccattcgtaaaagtgcgggaggaaggtcatgaataatctgcgtaatagactttcaggcgtgaatgggaaaaataagagagtaaaagaaaaagaacaaaaaatctggtcggagattgggatgatagcgggagcatttgcgctgcttgatgtgatcatccgtggcattatgtttgaatttccgtttaaagaatgggctgcaagccttgtgtttttgttcatcattatcttatattactgcatcagggctgcggcatccggaatgctcatgccgagaatagacaccaaagaagaactgcaaaaacgggtgaagcagcagcgaatagaatcaattgcggtcgcctttgcggtagtggtgcttacgatgtacgacagggggattccccatacattcttcgcttggctgaaaatgattcttctttttatcgtctgcggcggcgttctgtttctgcttcggtatgtgattgtgaagctggcttacagaagagctgtaaaagaagaagtaaaaaagaaatcatcttgaaaaatagatggtttcttttttttgtttggaaagcgagggaagcgttcacagtttcgggcagcttttttataggaacattgatttgtattcactctgccaagttgttttgatagagtgattgtgataatttaaaatgtaagcgttaacaaaattatccagtcttcacatcagtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgtttcatttggttctggcaggaccggcggctgcgagtgctgaaacggcgaacaaatcgaatgagctgacagcaccgtcgatcaaaagcggaaccattcttcatgcttggaattggtcgttcaatacgttaaaacacaatatgaaggatattcatgatgcaggatatacagcgattcagacgtctccgattaaccaagtcaaggaagggaaccaaggaaataaaagcatgtcgaactggtactggctctatcagccgacatcgtaccaaattggcaaccgttacttaggaactgaacaagaatttaaagaaatgtgtgcagccgctgaagaatatggcataaaggtcattgttgacgctgtcatcaatcataccaccagtgactatgccgcgatttccaatgagattaagagtattccaaactggacacatggaaacacacaaattaaaaactggtcggatcgatgggatgtcacgcagaattcattgctcgggctgtatgactggaatacacaaaatacacaagtacagtcctatttgaaacggttcttagaaagagcattgaatgacggggcagatggatttcgatttgatgccgccaaacatatagagcttccggatgatggcagttacggcagtcaattttggccgaatatcacaaatacatctgcagagttccaatacggagaaatcctgcaggatagtgcctccagagatgcttcatatgcgaattatatgaatgtgacagcgtctaactatgggcattccataaggtccgctttaaagaatcgtaatctgggcgtgtcgaatatctcccactatgcatctgatgtgtctgcggacaagctagtgacatgggtagagtcgcatgatacgtatgccaatgatgatgaagagtcgacatggatgagcgatgatgatatccgtttaggctgggcggtgatagcttctcgttcaggcagtacgcctcttttcttttccagacctgagggaggcggaaatggtgtgagattcccggggaaaagccaaataggcgatcgcgggagtgctttatttgaagatcaggctatcactgcggtcaatagatttcacaatgtgatggctggacagcctgaggagctctcgaacccaaatggaaacaaccagatatttatgaatcagcgcggctcacatggcgttgtgctggcaaatgcaggttcatcctctgtttctatcaatacgccaacaaaattgcctgatggcaggtatgacaataaagctggggcaggttcatttcaagtgaatgatggtaaactgacaggcacgatcaatgccaggtctgtggctgtgctttatcctgatgatattgcaaaagcgcctcatgttttccttgagaattacaaaacaggtgtaacacattctttcaatgatcaactgacgattaccttgcgtgcagatgcgaatacaacaaaagccgtttatcaaatcaataatggaccagagacggcgtttaaggatggagatcaattcacaatcggaaaaggagatccatttggcaaaacatacaccatcatgttaaaaggaacgaacagtgatggtgtaacgaggaccgaggaatacagttttgttaaaagagatccagcttcggccaaaaccatcggctatcaaaatccgaatcattggagccaggtaaatgcttatatctataaacatgatgggagccgggcaattgaattgaccggatcttggcctggaaaaccaatgactaaaaatgcagatggaatttacacgctgacgctgcctgcggacacggatacaaccaacgccaaagtgatttttaataatggcagcgcccaagtgcccggtcagaatcagcctggctttgattacgtgcaaaatggtttatataatgactcgggcttaagcggttctcttcctcattgagggcaatgctagacgggacttaccgaaagaaaccatcaatgatggtttcttttttgttcataaatcagacaaaacttttctcttgcaaaagtttgtgaagtattgcacaatataaatgtgaaatacttcacaaataaaaagacatcaaagagaaacataccctggaaggatgattaatgatgaacaaacatgtaaataaagtagctttaatcggagcgggttttgttggaagcagttatgcatttgcgttaattaaccaagggatcacagatgagcttgtggtcattgatgtaaataaagaaaaagcaatgggcgatgtgatggatttaaaccacggaaaggcgtttgcgccacaaccggtcaaaacatcttacggaacatatgaagactgcaaggatgctgatattgtctgcatttgcgccggagcaaaccaaaaacctggtgagacacgccttgaattagtagaaaagaacttgaagattttcaaaggcatcgttagtgaagtcatggcgagcggatttgacggtattttcttaatcgcgacaaatccggttgatatcctgacttacgcaacatggaaattcagcggcctgccaaaagagcgggtgatcggaagcggcacaacactagattctgcgagattccgtttcatgctgagcgaatactttggcgcagcgcctcaaaacgtgcacgcacatattatcggagagcacggcgacacagagcttcctgtttggagccatgcgaatgtcggcggtgtgccggtcagtgaactcgttgagaaaaacgatgcgtacaaacaagaggagctggaccaaattgtagatgatgtgaaaaacgcagcttaccatatcattgagaaaaaaggcgcgacttattatggggttgcgatgagtcttgctcgcattacaaaagccattcttcataatgaaaacagcatattaactgtcagcacatatttggacgggcaatacggtgcagatgacgtgtacatcggtgtgccggctgtcgtgaaccgcggagggatcgcgggtatcactgagctgaacttaaatgagaaagaaaaagaacagttccttcacagcgccggcgtccttaaaaacattttaaaacctcattttgcagaacaaaaagtcaactaaccgcaactttagagtaaagggctgattgtcaatgtgggagcagttgtatgatccgtttggaaacgagtatgtgagcgcacttgtggcgctcactccgattctcttttttcttttggctttaactgttttgaaaatgaaaggcattcttgcggcatttcttaccctagccgtcagtttcttcgtctccgtttgggcatttcatatgccggttgaaaaagcgatttcttctgttttgttaggaatcgggagcgggctgtggcctattggctacatcgtcctgatggcggtgtggctgtataaaatcgcagtgaaaaccgggaaatttaccattattcggtccagcattgccggcatttcgcctgaccaacgattacagctattattaattggtttttgttttaatgcgtttttagaaggcgcggctggttttggtgttccgattgcgattagtgcggcgctgctcgtcgaacttggttttaaaccgttgaaagcggcggcgctctgcttgattgcaaacgccgcctccggagcctttggggcgattgggattcctgtcatcacaggggcgcagattggtgatttgtctgctcttgagctgtcacggacattaatgtggacactgccgatgatctcatttttaataccattcctgcttgtattcttattagaccgaatgaaaggaatcaaacagacatggcccgctcttctggttgtgagcggtgggtatacagcggttcagacactgacaatggcggtgctcgggccggaattagcaaacattttggcggccttattcagcatgggcgggcttgccctcttcctccgcaaatggcagccgaaagagatttaccgcgaggaaggggccggcgatgctggtgagaaaaaggcataccgtgccgttgacattgcgaaagcgtggtctcctttctacattttaactgcggcgatcaccatctggagccttccagccttcaaagcgcttttccaagaaggcgggctgttatatcaatcaacgctcctgttcaaaatgccttttctgcatcagcaaattatgaaaatgccgccgattgcgccatctgccatgccgttagatgcagtctttaaagttgatctgctgtcagcgactggtacagcgattttagcggcggtcatcgtgacagggctgttcagcaaaaagttctcctcccgggatgcctttgcttccctgaaggagacaggaaaagagctgtgggtgccgattatgacgatctgcttcgtgatggggtttgccaatctggccaacttcgcagggctcagctcttcaattgggttagcattggcgaaaacaggagacctgttcccgtttgtcagtcctgttcttggctggattggcgtgttcatcaccggttctgttgtcagcaataatgctttgttcggccatttgcaggttgtcaccggagcgcaaatcggtgcgggttcagacttgctgttagccgcaaatacggcgggcggtgtcatggcgaaacttgtttctcctcaatctatcgccatcgctgccgcagcggtaggccaaacaggcaaggaatctaaactgtttaaaaggacagtggcgtacagcctgattctgttattgatcatttgtatatggacgtttattcttgcaagatttggagtgtaatagaaaaaagcagtacatgcccagcatgtactgcttttttatgttaatttgctttctttgtcatttcggctgttgttttcactctggcttttcccataaataaaatggtaaccgccgcgaggacaattggaatcaaagcgagcaaaaagacatacgtaatacttgatgacatcgcgtcaataatgcgattcaggatcgcatcaggaatctgggaacgtgttcccgcttggaatatctcttgcgggtcgccaatattttgcgtagcacctgatcccgctgagcctttcataccgctgaaggcgtcactcagcttgttcgtgaatacgtttgtttgcaccgttccgaaaatggtgacgcctaaggtcatgccaaatgatcgcaaaaatgaatttgtagagtttgccgttccccgaaagcgaggttcaagatcattcatcgatgccgccggcagcagggagaagttaaagcctacaccaaagcctgaaatcatcataaagactgtcagccatacccgtgctgtgtcaggcgtcatattggaaagaagcagcatgccgataaagaaagctataacagatatcagcatcaaattgcggaagcttgccttcgtttggaagattccgccgatcatgcttccgatgactgatccaatcatcatcggcgtcagaatgaagcccgcgcttgtcgccgagctgccgtagaccgcctgaacgaaaatcggaataaataccgctaaaataataaatgttccgccatacaggaaagcgagaatctgtgctgtggcaaacaagcggttcttaaacatccagaaagaaataatcggctcttctgcttttctctccacaataaaaaaggcaatgaagaaaacggcgaatacaataaacagcccgatgatctgaatggaattccaatcgtatgttttgccgccaagctcaagggcgaacatcaggcatacaatggatacgattaatgtaatcgcgccgccccagtctattttctgctttctgtgctccagagattctttgtagtagcgaataatgaaaaacaatgacaatgcgccgatcggcacattgatgtaaaacacccagtgccagctgatcgaatctgtaatgatcgcgcctaagagcggaccaagaacacttgataatccaaatacagcaccgaacatgccggacatttttccgcgtttttccggcggaaacaaatcaaagataatggtaaaggcaatcggcaggagcgcgccgcctccgatcccttgaatggcccggaagatgatcagctgattcatcgtctgggcaatcccgcataaagccgaaccgattaagaaaaaaataagtccaaacaggaaaaaacgttttcggccgtacatatcggaaagcttgccgtaaatcggcatgccagccataaccgccaccatataggatgccgtcacccaggcaaatttatcgaagcttccaagatcggctacgatattgcccatcgcggtggcaacaatcgtattgtccattgcagacatcaagatgcccagcaggagaccgaggaccacaaatttggtggaagcctgttttgctgttgttgtgtccatttgttctacctcctcttacttttctatgtaagttctgatatcatgataatagtttgatcattgaatatctcgattatcaagataaactcgattttatagggaggactgtcagttgtcaacaagaaattccagaagtgagttggaaaagactgctgttcagctttttcgaaaactgggcacaagaacggttctgtttcatcaggcagccgctcaagctctcggtctgtttcctaccgatttgaaatcagctgacattttaaatgaagcaggtccgatgacggccggagaactggggaaaaaaaccggcctcagcacgggttccgtcacggcgcttgttgaccggctggaaaaagcggggtatgtggctcgtgaaaaggacccgaacgatcgcaggagagtcgtaatcgtccctttgactgcttcgaaaaaacatataaaggatttgttccgtcctctgtctgagtcaacgatggatttgtgccgcgaatatacggaagaggagctggaactcattttcagttttgtaggcaaagccgccgatattatggaggaagagcttgaacgtctgaaacagtaagtgaatttgtgcatagcttggccctttcccgaataaattgtacaagatacataagaagggagtacgggccggtgaacatttttttgagctatattgtgctgggactgtccttgtctgcgcctgtggggccagtgaatgcggcgcaaatagacaaaggaattaaaaacggtttttggcatgcatggattttcggtttaggcgccatgacagcggatgggctgtacatgctttttatctatttcgggctgtcacagttcttgaccgctccatttgtaaaaacgtttttgtggctgttcggcttttttgtcctgacctataccggaattgaaacgctgaaaaacgtcagagaaccgatggatgtgagaagctcgcgggggaaaccgtcatacaggaaaacattcgcatcgggttttctcatttcattgtcaaacccattgagcatccttttttggcttggaatttacggaagcattcttgcgaaaacagcagaggcctacaatatgaatcagcttctaatctatagctccggcatcatgatcggcattttaatctgggatttctgcatggctatcacagccagtacgttcagaaacctgcttcatgaaaagctattgagaggattgaccggaatcgccggtgtatccctccttgtgtttggcttttactttggttatcagggcatcaaacagttattgggctgattcatgaaggacagtcacctgctgcttccagttttaatatagtatccagatgatactggaggtggatcaatggtgaatgggatttacaccaaaagttttctggaacgtattcaggaagagcttcctgaatggcaaagaatcgcttttgagctgctggcagaaactctgggggacgacgcggatacatttccgtgcattcccggacgccaggcgtttctgactgatcagcttcggattgcttttgccggagatccgcgggaaaaccgtacagcggaggaactggctccgttgcttgcggagtacggcaagatatcgcgggacacgggaaaatacgcatctctcgttgtgttgtttgatacaccggaagatttggcggagcattattcgattgaagcgtatgaagagctgttttggcgctttttaaatagactgagtcatcaagacgaaaaagaatggccggaagacattccggccgatcccgagcattataaatgggagttttgttttgacggcgagccgtatttcattctgtgcgctacaccggggcacgaggcaagaagaagccggagctttcctttttttatgatcacgtttcagccaaggtgggtgtttgatgacctaaatggatctactgcatttggccgtaacatgagcaggctgatccgatctcgtttagaggcctatgatcaggctccgattcacccgcaattaggctggtatggaggaaaggataatcgtgaatggaagcagtatttcctccgtgatgacgaaaaacaggtatcgaagtgcccgttttcttatttaaagaacatgttcaacaaaatgaaataaatcaaggactggcagggcgatctttatgaccctgctttttttgatagatcatggtaacgatggcgataatcacgagaaaacctatgctgacgaaaaaaccgggccggcttgatttttcaaacaatgtaccggacacagctgcagcaatcagaaccatcgctaaataaatttgcgtttttcccatgccctcgggatcagtcagctttttgctggagaacaggataaacagccaagtgtataaaagcataagccccgcagctgttgtcatatgctcataaatgtttttaggcagcactaacgacagaataatggagaggacaagccccgcaaacgtcagcccaagtgccggccagcatatttttttgccttcctttagagtaaagcatttcggcgcgtcgccgtcatcagccattgtacaaagcaatgtcgtaaccgcaaatagcgaagcgacaagagtcgagaaccctgcgatgatgaaaatcccgttaaatatatcaaggatgatctcaaggttatatccttttaatgacgtaatgaacggactgtcctgttcagtaaacgcgtgtaacggaaccaaaagcagagcaagcccgattgaaatgatataaataatcgccagcgtcgccagcatcagtttccctgattttgacgcttcctcaggtttttttaagtgaaccgccatcagccccatgacctcaattccgccaaaagcgtaaaacgcgtagattaaacctgtccacagccccatggcgccgtatgggaaaaactcactcgtcttatttggaacatgtatgccatgatttccgccggacaggataccgcataaagccaggatggcaatgacaataaacataaaaatagcagctgttttaatgactgccagcacgttttctgttttttcaaagacggacaggccggtgaaaataataaggagccccagtactgcgtagattgaggcaaacacccatagcggcacttgaggaaaccaatgcttcgtaaagagcgaaatggctgtcagctggcttccggtaatcagcatttctgatgaccagtacacccagccgttgctgaagcctgcccatttgccgaatgcttttcgggcatacgcacaaaacgaacctttttccggctgcttcgccgacagcttggcgagctgttcaaagacaaaatacgtaccgatccctgcgatcagaaatgaaaggagaacggaaaaaccgctttttacaattgcgatgctggaaccgagaaagaagcctgttccaatcgtgcagccgactccgatcagtgacagctgccaccaagccagattcccttttggctggtctttttttgtttggctcattatttattcaaccccttttatctaaggttagattgtgatctgtccgaagcttatatacatcggatttttgcctctttttacatggagaaggaagcggacgctcatactaatgaaaaaaggagcaaaccaatgacacagcaatatattgtggagccgaaaaaagggcttgggctgaagctgaaaaaggggcagattttaaaggtggttgatgtagaagggcagcaggtggctgattttgtcgcataccatgccaaggatttttatgaacaccttgatcagggagcgacgatagacgccaatcactccattcatgtgaaggtcaacgaccatctctactccaacctgtataagccgatgttaaccctgattgaagatacggtcggcaagcatgatctgctgctgcccgcctgccgtcctgatatgaacaggctcttatatgggaagcaaaaggatgagtttcaggatacgtgctatgacaatatgaaccgtgcgcttgagcagtttggcgtaccgaagcctcacatgcattacccatttgcgatttttatgaatactgtccttgatgagaaagggaatctgtctgtggaaacgccgctttcgaatgccggagattatgtaaggctcagggcggagatggatttaattgtcgcgttttcttcctgcccgattgaaaaagggaaatgcaatggcgacagtgtgacatccatacgggttgaagtcagctgatctctcttgttcactgtgaatgaagacctgtgctatatttaatagggatacataacagtcatgattcattttcattgatttggggaaatgatcagtaacaagggaaaatgtacaggaggaatgattgggatgagcatgcaggaaaagattatgcgtgagttacatgtgaagccctcaattgatccaaagcaagaaattgaggaccgagtcaattttttaaaacaatatgtaaagaaaaccggtgctaaaggctttgtattgggaatcagcggcggccaggattcaacacttgcgggaagactcgctcagcttgcggtggagagcattcgcgaggagggcggagacgctcaatttatcgctgtccgtcttccgcatggcacacagcaggatgaagacgatgcccagcttgctttgaagtttattaagccggataaatcatggaagtttgatattaaatcaacagtcagcgctttttctgatcagtatcagcaggaaacaggcgatcagctgactgactttaataaaggaaacgtaaaagcaagaacaagaatgatcgcgcaatacgcgatcggcggccaggaaggccttcttgtgttaggaacagaccatgctgctgaagcagtgactggtttctttacgaagtacggtgacggcggagcagacctcctgccgctgacaggcttgacgaagcgccagggaagaaccctgctgaaagagctgggtgcaccggaacgcttatacttaaaagaaccgactgccgatctgctcgacgaaaaaccgcagcagtcggatgaaacagagcttggcatttcctacgacgagattgacgattatctcgaaggaaaagaagtatcagcgaaagtatcagaagcgctggaaaaacgctacagcatgactgaacataaacgccaggttccggcgtctatgtttgatgactggtggaaataagttgaagaaagcccgctctcggagcgggcttttgtcgtgtacaggagctttatttgatgcggatatgattcagctttaccattaatctgtcggtgaaccttcggaggctgcctctcgtatcaggatctaatgggagttcggctctcgcggcaatgttctctgccacatcctgaatcgacaggttgtctgtttgaatgtggtcctcaaaaatgggtgatgataaaccttcaacgcagcggtcaatttgtttggctgcccatgagttttttccttctgctctggtgcgcagcctttttaacaaggtttcctttgaagccattaatgtaaagtggtgaacgatccttccttcatgtctgagcctgccgatgatctcattgaagtattcaggatgtacaatcgtcataggcacaataatgatgccgcggtatgtatctgtcagagaagctagcaaactgtaattgaacgcccgccataaaggatagctttgaaaatcgtcctttgcgatctcctgcggcaccatggagcgcagcgcaaaacccattttctcgggatcatacacgtaagatgggttcagccttctgtgcagttcgaaggctgtttgtgtttttccggaaccgaatgccccgtttatccaaatgatcatcgccatttctcccttcctattcatcatacagaaaaagacccttccatcgaagagtcagctggaaaaacaataaaggcagaaggttttaacgcttttttgcgtcgaagtattaaaatacctgcagaaatgttgtacaatgaatgtcattcaggcaaaaatggctaaacaacaaagcgcactataagcttgaccggtaaatccggtatctatataaatattcgctaaataagcatataatgaatataaaatttcattccttaggaggatttcgccgaagatgaacgctaaacgagccatcccagtaagagaaagaaatatcgtcctgatcggattcatgggtgtaggaaaaacaacaatcggccaattggtcgctaaaaaattatatagagattttattgatattgaccagcagatcgaaaaggatttcaatatgtcaattcctgagatatttgagaaaaagggagaagactttttccggaaaacggagaaggaatatattttagacatctgccatcataaacgattcaaaatcgtatctctgggcgggggatcttttaaacaagaagaaatcaggaattgctgtctggaaaactgtctcgtgcttcatctggacctgtcatgggagaactggaagcagcgcgcggatttattgatcgaaagccgccctgtactgcataaccgttcaatggatgaaatggaacagctgtttaacgaaagaaaagtcatttatgacaagcacaattcaaaagtggcaacagacaacctttccccggaagaggttgccgattacattgttgagacattaaaaattggctgggatctttatcagccgatgtaaaaagccgtgcgcagcgcacggctttttttatcgttttatcccttgtatcaaaatcgcttttaaacaaaaggagatgggctgtccgttttggttcaatgtaatacagaacgtgtcgcgtgcttcgtctgatgcgtgattcaagtgggtaatgatttgtttttctcggtcagcgggggttccgcctcgtttgatccagctatcgtattgaatcggcaaattccacttttggatgtcttgataggccagttgattggcgctgaacatcgcctgccattctgataatgagctttcacgaacatgggaagggtctcgaagccggttcaaatgattgacaaactcatcaagaacgggatcttcaggcgcgtaatgatcaactaagagaaaacgtccgtcctgttttagtacgcgtgcaacctctctgacagctttgcggacatctgaaaaatggtgggctgcgtatcggcaggtgatgatgtcaaatgaatcgtcggggaaggggagtgactctgccgttccttgctgaaagcgtacgttttcagatcctttttcttgcgcgaaggaggacgcaacctcaaccatctctttcgttgcatcaacaccgatgcactcctgtacataaggagaaaatgccagggccgtatggccggcgcccgctccgatatccagcacccgatgctctgcccggcattccgctgttttgatcatcaaccccaaatcttccccctcggcaaataccttttcatcccgatacatctcggcgtttttagaaaacggtgtttcatttgtcatttgaaccagctccttcttttcgtaaatgatgatatggattatgttagcaatttctgttatgattcgtccaagatataaaaatgatgaaaacgataggttcaacctatggaggctgaaatggatattaaagtgatggaatatgcagcggaaattgcccggcgccaaagctttacaaaggcggcggaacatcttcatatcgcacagccgtctctcagccagcaaatcaaaaagcttgaggctgagctggagcttaccctttttcacagatcccatggctctgttacattgacaccccacggcaggcgtttcattgaaaaagccgaggacatcattcgttccagagatgatttgcttcgggaaatgcaggagcgatcacagggaatcggtcataaattatccatcgggattcctgctgtaacagggagatatctctttcctccgctgctgaagcagtttttggcgcgctatcctcatgtggaggttcagcttgttgaaaaagatccggtttcattagaggagatgacggcaaagggagaagttgacctttctgttttatccttgccgatcgaggatgaacggctctccattatacccttgctcacggaaccgattgttctcgcggtgccgaaggaaaaacaaaggtggatgccgccggaaatggtcgcgctgattgagaaagcgctggaagaagatgagggacgccagccgtgtgtgccgattgacatggtaaggaacgtgccctttattctgttaaaagaaggcttcggctttcgcaggacagttctcgatctctgtgcggaaagcggctttaagccgaatgccgcctttaagacgagccatattgaaaccgcccaatctcttgtggctaacggattaggtgtgacaatggcgccgaatatggtcagaagggataaagatccgggtgtgatctatttatcgattcaatccgcgccatcacgaaccctcgtcttcgtctttttaaagaaccgctatgtcagtctgaccgcccgggcctttatggaactaagccgggaaagtcttaaacaaacgtttgatgaaggctgtctgggaaacaatgatgaaaatatttagaaaacaaagccgaaacgtggtagtataggaatacaaactatatcttataaaacaaaggggaataatcggaaatgcaactattcgatctgccgctcgaccaattgcaaacatataagcctgaaaaaacagcaccgaaagatttttctgagttttggaaattgtctttggaggaacttgcaaaagtccaagcagaacctgatttacagccggttgactatcctgctgacggagtaaaagtgtaccgtctcacatataaaagcttcggaaacgcccgcattaccggatggtacgcggtgcctgacaaggaaggcccgcatccggcgatcgtgaaatatcatggctacaatgcaagctatgatggtgagattcatgaaatggtaaactgggcactccatggctacgccgcattcggcatgcttgtccgcggccagcagagcagcgaggatacgagtatttcaccgcacggtcacgctttgggctggatgacgaaaggaattcttgataaagatacatactattaccgcggtgtttatttggacgccgtccgcgcgcttgaggtcatcagcagcttcgacgaggttgacgaaacaaggatcggtgtgacaggaggaagccaaggcggaggtttaaccattgccgcagcagcgctgtcagacattccaaaagccgcgggtgccgattatccttatttaagcaacttcgaacgggccattgatgtggcgcttgaacagccgtaccttgaaatcaattccttcttcagaagaaatggcagcccggaaacagaagtgcaggcgatgaagacactttcatatttcgatattatgaatctcgctgaccgagtgaaggtgcctgtcctgatgtcaatcggcctgattgacaaggtcacgccgccgtccaccgtgtttgccgcctacaatcatttggaaacagagaaagagctgaaggtgtaccgctacttcggacatgagtatatccctgcttttcaaacggaaaaacttgctttctttaagcagcatcttaaaggctgataaaatgtgaaaagccgccgcatatcatcaggcggtttttttctgcaaactgccggaatgagaacagactggagacgaatagatatgaaacaaagaatcattgatgaattaaaacggatcgagcagtcatacggagttaaaatcgtgtatgccgtcgagtcaggaagccgcgcatggggatttccctcgcaggatagtgattacgacgtccgctttatttatgtgccgaaaaaggagtggtatttttcaattgagcaggagcgtgatgtcattgaggaaccgattcacgatttgctggatatcagcggctgggagctgagaaaaacgcttcggcttttcaaaaagtcaaaccctccgctcctcgaatggctgtcctcagacattgtgtattatgaagcatttacgaccgcagagcagttaagaaaactgcggacggaggcatttaagcctgaagcaagcgtgtatcactatatcaatatggcgagaaggaacgtcaaggattatctacaaggacaagaggtcaaaattaaaaagtacttctacgttcttcggcctattttggcctgccaatggattgaaaagcacggaactataccgccaatggactttactgttttgatgaatgaacttgttgctgaacccgagctgaaggctgaaatggaaaccttgcttgaacggaaaagaagaggggaagagcttgacctcgaagcaagaatcgatgttattcaccaattcattgaaacggaaatcgaaagaatcatggaagcggcaaaagaactgaaggcagagaaaaaagatatgacatctgaattgaaccgtttgcttttgaatacggttgaagaagtgtggaaggatggaggaagctgatgttttttgtcgcttccttttctgctttattcgacagaatccccccgactttctaactatctgattgtggcaaatccacaaaaataatcagaatctttgtattttgagaatattgtgaacgcctgttttgtccatttacaataaactcatacaaatacttcttagattgcggggtgttgaggttggaagtgatcacaagagattttttcttatttttatccaaaagcggctttctcaataaaatggcgaggaactggggaagccgggtagcagcgggtaaaattatcggcgggaatgactttaacagttcaatcccgaccattcgacagcttaacagccaaggcctgtcagttactgtcgatcatttaggcgagtttgtgaacagcgccgaggtcgcacgggagcgtacggaagagtgcattcaaaccattgcgaccatcgcggatcaggagctgaactcacacgtttctttaaaaatgacgtctttaggtttggatatagatatggatttggtgtatgaaaatatgacaaaaatccttcagacggccgagaaacataaaatcatggtcaccattgacatggaggacgaagtcagatgccagaaaacgcttgatattttcaaagatttcagaaagaaatacgagcatgtgagcacagtgctgcaagcctatctgtaccggacggaaaaagacattgacgatttggattctttaaacccgttccttcgccttgtaaaaggagcttataaagaatcagaaaaagtagctttcccggagaaaagcgatgtcgatgaaaattacaaaaaaatcatccgaaagcagctcttaaacggtcactatacagcgattgccacacatgacgacaaaatgatcgactttacaaagcagcttgccaaggaacatggcattgccaatgacaagtttgaatttcagatgctgtacggcatgcggtcgcaaacccagctcagcctcgtaaaagaaggttataacatgagagtctacctgccatacggcgaggattggtacggctactttatgagacgccttgcagaacgtccgtcaaacattgcatttgctttcaaaggaatgacaaagaagtaaaaaaggagagattatcatgacaacaccttacaaacacgagccattcacaaatttccaagatcaaaacaacgtggaagcgtttaaaaaagcgcttgcgacagtaagcgaatatttaggaaaagactatccgcttgtcattaacggcgagagagtggaaacggaagcgaaaatcgtttcaatcaacccggctgataaagaagaagtcgtcggccgagtgtcaaaagcttctcaagagcacgctgagcaagcgattcaagcggctgcaaaagcatttgaagagtggagatacacgtctcctgaagagagagcggctgtcctgttccgcgctgctgccaaagtccgcagaagaaaacatgaattctcagctttgcttgtgaaagaagcaggaaagccttggaacgaggcggatgccgatacggctgaagcgattgacttcatggagtattatgcacgacaaatgatcgaactggcaaaaggcaaaccggtcaacagccgtgaaggcgagaaaaaccaatatgtatacacgccgactggagtgacagtcgttatcccgccttggaacttcttgtttgcgatcatggcaggcacaacagtggcgccgatcgttactggaaacacagtggttctgaaacctgcgagtgctacacctgttattgcagcaaaatttgttgaggtgcttgaagagtccggattgccaaaaggcgtagtcaactttgttccgggaagcggagcggaagtaggcgactatcttgttgaccatccgaaaacaagccttatcacatttacgggatcaagagaagttggtacgagaattttcgaacgcgcggcgaaggttcagccaggccagcagcacttaaagcgtgtcatcgctgaaatgggcggtaaagatacggttgttgtcgatgaggatgcggacattgaattagcggctcaatcgatctttacttcagcattcggctttgcgggacaaaaatgctctgcaggttcacgtgcagtagttcatgaaaaagtgtatgatcaagtattagagcgtgtcattgaaattacggaatcaaaagtaacagctaaacctgacagtgcagatgtttatatgggacctgtcattgaccaaggttcttatgataaaattatgagctatattgagatcggaaaacaggaagggcgtttagtaagcggcggtactggtgatgattcgaaaggatacttcatcaaaccgacgatcttcgctgaccttgatccgaaagcaagactcatgcaggaagaaattttcggacctgtcgttgcattttgtaaagtgtcagactttgatgaagctttagaagtggcaaacaatactgaatatggtttgacaggcgcggttatcacaaacaaccgcaagcacatcgagcgtgcgaaacaggaattccatgtcggaaacctatacttcaaccgcaactgtacaggtgctatcgtcggctaccatccgtttggcggcttcaaaatgtcgggaacggattcaaaagcaggcgggccggattacttggctctgcatatgcaagcaaaaacaatcagtgaaatgttctaagcgggactaaatgggcatcctccctgcgggggtgtccatttcatccatatactataaaaaagaggaggaagtgccatagaaaacacacagctgattatttcgatttgtatttatatggcgggaatgctgctaatcggctactttgcttacaagcgtacgtcgaatctgacggattatatgctgggaggacgctctttgggtccggcagtaaccgctctcagtgccggcgctgccgatatgagcggctggctgctaatggggcttccgggcgccatgttttctactggtctgagcggcgcttggatcgtcatcggactttgccttggagcgtgggcgaactggctttacgtcgcaccgcggctgagaacctatactgaaaaagcggggaattccattacaattcccggattcctggaaaatcgcttcggagatcaaacaaagcttctcagactgttttcaggaattgtcattttagtctttttcacgttttatgtatcgtccggaatggtgtccggcggcgtcttattcaacagcatcttggggatggattatcacaccggcctgtggattgtgacgggtgttgttgtggcatataccctgtttggcggctttttggcagtcagctggacagattttgttcaggggattattatgtttgccgcactcattcttgtgccgatcgttacgtttttccacacgggaggagcaggtgatacagttgctgaaatccgctctgtagatcctgatatgtttaatattttcaaaggaacgagcgtccttggcattatttctttgtttgcctgggggctgggatactttggccagccgcatattattgtgcgttttatggcgatcacgtctgtcaaagagatcaaaagagcgcgcagaatcgggatgggctggatgattttgtctgcagtaggcgcagtgctgaccggtttgggcggaatcgcttattaccatcagcgcggcatgacactgaaggacccagagacgatttttattcaattagggaatatcttgtttcatccgattatcacgggttttctgatttcagcgattttggctgcgattatgagtaccatttcttctcagctgcttgtgacatcaagctctctggtagaagatttgtataagtcgatgttcagacgctcagcttcagataaagagctggtgtttttaggccgtctggctgttctggctgtttcaattgtcgcgttggttctggcttgggagaaaaataacactatccttggattggtcagctacgcgtgggcgggcttcggtgcatcattcgggccggttgtactgctcagtctgttttggaaacgaatgaccaaatggggggcactcgccggcatgattgtgggagcagcgactgtaatcatttgggcgaatgccggtctttcggactttctgtatgaaatgatacctggttttgctgcgagtctattatctgtgttttttgtcagcatattgacgcaggctccgtcacaagctgtcacagaccagttcaacgactaccaagatacaatgtcacaataaagatcgaaaggaggaggaaggggctgtccctttttcctcttttctccttttaagcggccatttttttcttttggaaacaaacgtatttttttctatacaaaaagaccccgtatggatatgattaaagtaaaaaaagtataggagaaaaaggtatggaagagcttttagagagagttttttcattttcagatgttgataaactgattgattttattagctatgagctgcaaaagccagtgatactggaaagcgcggatttctttttgttagcctataattcttactatattaaccattttgattctgccaaccagcagactatttttcgaaaaagtgtccggtccagatttttgagaggtttctgaaggacggaattattgaaaaattgaaaacagagcctgagccttttcgcgtcaataaaattgaaagcattgggttaaaccagagggtggtcgtgagtgcaaagcacaaaggggaagtcatgggctacatctggattcaggagctggaccaaaatctgacggatgaagagctcgactttttgtacgagacctccttccatgtcgggaaaatcatttataaaacgaataaattgaaacaggaaaaggaagaaaaagcagaggatctcatcaaacgggcgatctatcagcaatttacctctgagaaggaactcagacgggaagctgaaaggatcaacaccgtgctgccttccatgttttcagttgtgatcctgcacgccgcaaatggggatggggaagcggtagaggatttaaaggaaaatatcaggtcgtacctgaatttacgggataaggtcagtcatgtcttaacgatcgaatcaaatattgtcatcgtcgtagcgagtttttcccaaaaaagctccgtctcctcagcagcttctgagtttattaacaagctgttaacacattttcactttcaaaaaatacctacccctatttatatcggtatcggaaacgaatataatcacctattaaaacttggcaagagctacacagaagcacttgaagtcatcaaagccgcagaaatcaccggcaatcaggaaaacattccatatgaatatgccaaactcggcatttaccgctatttagaaagcatcgaacagaaaaatgaatttttagaatacgagaataaagatttagctttattaaaagcgaaagacgaagaaagcagcactgagctgctcaaaaccttggaaatctatctcctcaacaactgcaaaacaaaaccagcggcagaacagctgtttattcaccaaaatacattgaattaccgcatcaaacagattactgagatgacgtcgatcgatttaagcgatttcagaacgcggtgccagctctatctcgatttgatgctgatgaaaaagaaataaaaaagaaaccagtacttgtactggtttcgtcttcacttaaaatcctctgtaaacatacggatcatcaggttttttaatggtattccagtcagttactttgacgacagggagagttgacttgaatggctggtaatattctgaggccagagtgcccttaatgtgaatccattcatcatccttgatgtccatgtccttcggaaattccacaagcatcccgtacacgccggaatcagcgatacagtgaatgatgccaaaccttaatacgaacaactgatttttgttaattgcgtttcctttgtaagcaaatccatgaaattctatcgtccgtccgagaaattcacccggatagttatagatggtttccattccttttaggaaatcgtcatcggtcagagaaatctcttttttgctggaatacttattaaacagctgtttcatttgtttgtcatagctgtcttgcgcgtaataaaggctggcatcaggccgcaaatactgagtttgggagtagtgatctccgctctccatcgccttaaacgagaacccttttgttttgactatggatgagtcaagcgttgcaatcgggaagaagatgcctgacaccaaaggaaaaagaaaaacaacataaatcaaataacgctgataaaatggcttgttttgttcatggtcatgctcgtgatcatggccgcacccgcaatcatggtcatggtgatgcccgcttttttcaggcgacttgataaatagatatgcttggacggcggtcagaatggccagcaggaaaatcgcaataaaggaaagataggcatatttcatattgatatattttgttagatttcctgaggcatgcagatgataaaagaaaaacgtaaatcccatcagcaccaatagacgaaacatccaatcacccctttaccagtagtgatcccgctaaaacaatcacgacaatgtatgtaatcagcaggaaaacaaatcgttttttgaaggccgcaagcatcatcaatagattcttaatatccaccattgcgccaaagacgagaaaggcgattaacgatcctaatgaaaatgtgctgctgaaggaagacgcgatgaacgcatcaacttctgaacaaagcgacaggacaaacgccagacccatcatcacgagagaagaggatacatcattctgcccgatcgcaagcagagtggatgttttgacatacgtctgcatagcggctgcgataaaggcgccgatgattaaatatttccccacggagaaaaattcatcaatggcatgccgcaaggtcccgcccagtttttggagcaaggtgccgtgatgatgatggtggtgcccgggttcatcaggctttaaaagctggttatccttaaattgataggataaaatgaccccgatgatcagcgaaacggcgagagccagtccgcctctgtaaaagaccacgctccatctattcccgaacgcaatataagtagaaaataaaacgataggattaatgataggcgcggtcagcatgaaagcaacgcccgcatgcagaggaactccctttaacagaagccgcctcgtaatcgggatgatgccgcattcgcaggcgggaaataaaacgccggccagcgcaccgaataaaacggcgagaaaacggtttttcggcatgattcttgcaatcatttcttcagaaacaaacatttgaatgattccggaaagtatgacgccaatcagaataaacggaatggcttctattaaaatgctgataaaaatagaattcagctgaagaaaagatgattgtgctgtcacaataaaacctccgctcatgttaagctgcctttcttatgataccagaaaaaaaggcactgcttgtttgacggaggaagggaaaggatcgtttcactttggttaggattccaaaaaaccgagtaggatactgtctgtttctgcagcttcttttccgagccaaatcaggtgtccccatgagtgaagcaaacagagaacagcgccacgaatgtgctcttttgcatgatgtgcatgtgacaagtcaaccaatccatcataaacactttgcataatcagcacgggacatatgatggcttgcaggtcttttaaagagacagcggcggtttgtgacaagtcaatcagaaatccttcacccgagcgctgccggctgttcattttccgaaatgcttctatgtctttttcattcatcaaggacttgattcgctgaaacggaagcgtgctgaatttggggctcatagcttgaaacatcaaacgcgggaaagcgttattcaaggaagaaatcagcttccatatccacttttccaccggcgggcggaagagaattctccccaatttatattcagtgtcttttggggtgagccactctttggtgaccgcggattgcagggtcaatgtatttactctttccggataatgtgaggcaaagcatatgccgctcggccctcctgctgagatggcgatcacatggacactgtcgatttgtaaatgatctaataatttcacatagaaacggcaggcgttggcaagactttttccaatttcttttgacgttcgtccatagccgggccttgaaggcgtaatgatggaatacccttgctcaatcaacgctgtgtatccgaattcctcgtaacaatttgaatgcccgccatgcatgacaaggatgggggcaccctttccagccactgaatattctagtgtatgtccttcgaaggtgatcgtttcgactcgtcttttcatctgttactcccatatgttttttgcctattatagggttttcaacaattgatcacaaggtgaagaaatgaataaacaaaggcccttgaatatgatatactttgtattgatattcattctcaattaaaattttgatatagatgtgaacgggaggcaggacggatggctgagaatcaagaggtatatgacgttacgattataggcggggggccgattgggctgtttactgctttttactgcgggatgcgggagctgaaaacaaaggtaatcgaatttttgccgaagctcggagggaaggtgtctttattctttcctgagaaaatcattcgcgatatcggcggcataccggggattgcgggaaagcagctgatcgagcagctgaaggagcaggcggcaacgtttgatcctgatatcgtattgaatcagcgtgtgaccgggtttgaacgcctagatgaaggcaccattgttctgacgggttctgaaggggaaaagcactatacaagaactgtgattttggcttgcggcatgggtacacttgaggtcaatgagtttgacagcgaggatgcggcccgatatgcgggcaaaaatcttcattatggagtggaaaagctcgatgcgtttaaagataagcgcgtggtgatatcaggcggcggagatactgcggtcgattgggctaatgagcttgaaccgattgcggcgtctgtgactgtcgttcatcggcgtgaggaattcggcggaatggaaagcagcgtgacgaaaatgaagcaatcatcggtgcgggtgcttacgccttatcgtctgaagcagctgagcggcaatgaggagcgcatccaaaaagtgacgatttgccatacggagactggccagagggaagacatagaaattgatgagctgatcatcaatcatgggttcaaaattgatctcgggccgatgatggagtgggggctggagattgaagaaggcagggtgaaagctgacagacatatgcgaacgaatcttccgggcgtgtttgtggcgggcgacgcggctttttatgaaagcaagctgagattaattgccggcggctttaccgaaggcccgacagcagttaacagcgctaaggcttatttggatcctaaggctgagaatatggcgatgtattccacccatcataaaaaattggtacataaataaaacagcccttggggaaagggctgtttgccatcagctgtgaaggagctttttctgcgtctgttgattctgaatgaaagctagcaattcatcctgttcttgtacagctgtgaatccataagcttcggcagctgagtcatcgcctatacagacgatagggggccggcttgctgacggttccggcaaaatgccaatttgttcgccaccattgatcaattgctgaacggacagcttgttcgggcaaatgaccatgtgcagcggggattcactgatggtacgctgaatcatgtgggtgaaccggtcatctatgacgttttcatgagtgatataaaacgaacaggattcatgcttttgcatgttttccactgcatggcggctcccgacaacaagacgtttctctgaatcaggctgaatggcggtgacaagaaagccccgtttctcaagctctgtctttgcttgctcagatgctgcactcagtttggctgtcagctggcggatgtcgattttctgagaagccagtgctctgaaaaattcacaaactgcccggcgcgatgtgaaaaaaacgtcttcaaaggtgccaatctttcgaagaatgtcttcattgacaggcatgttttcggtccgccatttcggccactcgatgacatcggcgccggaatcgcgcagcttgtctgcaagcgggtcttcatcttcgccatgagtcacaaccatcaaatgccgtccgatgagcggtttgctttcaaaccagccgtgtgtttgaaagttgacgatgtctccgatgacgataatcgcggggtttgtaatctggtgttcctgcactttttgctgaatgttctcaagtgttcctttcacactccgctggcggccccacgttccccattggatgacaatgacagggacagaaggtgatttcccgtatgaaataagctgctggcaaatataagacaagttcttgacacccatgtaaaaaacaagggtttgtacgcttcgggcaagcccttcccagtcaaggttcggcgtgccttttaatgatttatcatgcgctgtaatcatggcaaaagacgatgcgaaatcccgatgcgtgacggggatgcccgcatatagcggcgctgcaattccagaggtgattcccggcaccatttcatagcgaatgccgtgctcatgaagagcatctgcttcctcgccgactctgccgaatacgctcggatctccgcccttcaagcgaacgacggttaacccatttaatgctttttcaaccagcagggcgttaatttctttttgtttcataaaatggcggtttggcagttttccgcaataaataaactggcagtccggtgatgcaaattcgagcagcttcgggttggcgagccggtcatataaaatcacatctgcttcctcgagcgcctgttttcctttgatggtgagcaggcctgggtcgccgggtccggctcccacgaaatatacgattccgttcttcatgatcatgtcatccttccgtcactgtaaaaaatgaaggaccactagaaaagtgatccggtcttttgatcaatatacgagataaacatgttctccttcgatcagcgtttcatatgttttgacgcatccgtggtcaggttcttggacgattccgtcttctaaggaaattttccagtcgtgcatcgggcagaaaacatattgaccgctgacgatgccttctgccaggacgccgcccttatgcggacagcggttttcgatggcgcggatgcttccgtctgaaagcttgaaaaccgcgagctccttatcttcaatatacactgttttgcctaattgttcaggcaattcttcaatttttccgatacatacttttgttacgtctttgtttaccatgcccattcctcctcaatgattgtttttgtcattatgatgtggtcacgacattttcaaataattctttcgaggtttgtttatcctctaaaaagtctttccacggatccttgtggacagagagtgtttcattcattcggtcgttcagctcctgccgcttttccggatcgtttaacacggattggacatgggataaaccgacgcgctcaagccatgcggacgtacgctccagatagtttgcggtttccctgtaatattgcaggtaagcgcctgcgtattctaagacttcttcatttgttttcaccttcatcagcaaatcgccggcacgcaagtgggttccgccgtttccgccgacataaagctcccagcctccgtcgatgccgacaacgccaaggtccttaatgccggattccgcacagtttcgcgggcatgcagacacggccatttttactttgtgcggcgtgtttagcccttcgaattttttctcaagcgcaatgcccagtgccatggagtcttgtgtgccgaagcggcagaattgctcgcctacacaagttttcactgtgcggagtgtttttccgtacgcgtagcccgacggcatatcaagatcttcccataccttcggaaggtcttcttttttcacgccgataagatcaattcgctggccgcctgtcattttcacgagcgggatctcatatttgtcaacgacatcggcgatcttgcgcaagtctgtggagttggtcacgccgccgtacatccggggaacgactgagtatgttccgtctttttgaatgttggcgtgcattcgttcattaacaaagcgggatgtccggtcatcctcatatttggttggattgatcatgcctaagtagtagttcagagcgggccggcatttggaacagccttctggcgttttccagccgagcacattcatgacttctcttgtatgtgacagccctttggctttgatttcttctacgacttcatctctcgacaatgtggtgcagccgcaaatggattctttttgcgctgacgcatcaaagtctgatccgagcgtatgctggaggatttcttctacgagtggcttacagcctccgcatgagcgggatgcgccagtgcatgctttgatttcgtccgttgacgagcagcccttttcctgtatggcttgaataatcgcaccttttgacacgccgttacagccgcagatgatttcatcgtcgctcatcgctgcggtaatgcttgtgcctgcttcttggctgagaggctgtaagattgatattttagaggtttcagagatatcggcttctttttgaatcatagaaaacaggcgattgccttcgctgctgtcgccgaataaaacagcaccgactatttgattgcctctcaggacgatttttttatagatgccgtcctgctcatcgaagactttaatcgcttttttctcttctgattcgttaaagtcaccggcagagaaaacctcgacgcctgatacctttaactgtgtggagagaacggagccctcatacggttttgtttcgatgccgcaaatatgcttcgccagcacttttgcctgttcatagagcggtgccacaagcccgtaggcgatacctcggtgctcggcacattcgccgaccgcgtaaatgtgcgggatttcagtctgcatataatcgttgacgatgatgccgcggttaaccggaatgccgctctcggcgccgagtgttgtattcggacggatgccgacagccatgacgactaaatcggcttcaatgcttgtgccatctttgaagcgaaggccttcgacacggtcatcaccgacaatttcttctgtttgcttttcaagtaaaaaggtcataccttgtttttctaactcgttttgcagcaggcgtcctgccgttgcatcaagctggcgctccatcaggaatggggcaaggtggatgacggacacatccatgccaagattcagcagtccgcgagctgcttccaaaccaagaagtcctccgccgatgacggcagcttttttatattgttttgacgcggcgagcattgtgtctgtatcttttatgtcccggaaagctgtgacgccttttttgtctgcgcccggaatcggaaggataaaagggaccgagcctgtcgccaggatcaattcatcgtaaggctggattctgtctgcatctgtgatgactgttttgttttccgtgtccactttgatgactgtttcatttgtatacaattgaatgttgttttcttcgtaccagtcccaatcgtttaacgtaatatctttaatatctgtatcgccttgaagcacttttgacaaaaggattcggttgtaattgggatgcggttcggcaccgaaaattgtgatctgaaactcgtctttagcaacactcagtatctcttcaatggcccttaccccggccattccattaccaacaagaactagctgtttttttcccatcagatgatccgctccttatcaatgttttttccagcgtagcacagcaaaaaggaatatttaagatacatgttataaaatgtaacaaaatatacgaaaagttctaaaaattttatgaaaaatttaaataggtctgattcggacggcgcataccttaaaaccgggcattttacaggctggatctaaggcttccccgattaaatcattcacattttgagcgtctgcccaatggatgggaacaaaaacagtatcttttctgatttgttctgataatttgctgcggacggtgatgcttccccgcggcgattctatttttaccagtacacggtcctcgatattgtaggtcgctgctgtttgcggatggatttccataaacgattcaaaatgtctcgcggcaagggcggcgctttttcttgtttggacgcctgttaagtagtgagacatgactctgcctgtcgttaaataaagcggataatcggctgtcggcttctcttttggaacaggtggttcgtttggaatcacacttaatgccgctttttgatccggatgagcaaatgattctgtaaacaagcgcccagttccgggatgatcagattccggacacggccaatgaatgccgccttcacgtctgagcctgccgtatgagatgcctgaataatcggcaatcccgcctcggctcgcttctctcaattcattaaaaatatcctccgctgacgtataagaaaagtagcggcccttgccgagagcggatgcgagatcacaaatgatctgccaatcatgctttgcttcgccggggcatggccggcttgcttctcttaatgtcacgcgtccttctacatttgtcatggtgccttcatcttctaagtaagaggaggcaggtaaaatcacatctgcgtatttcgcagtctcagaaataaacaaatcgattgcaacaaagaatgtcagtttccttaaagcctttttcacgagattcgcatttgggctggagacagcaggattggagcacatgaggaacaatcctttgatgtcgccgtcgttgattttttccatcatttcataggctgagacaccttttcgcggcagatcatcctgatggattccccacactttcgcaacatgtgcccggtgttgttcgttttcaatagatcgatagcccggaagctgatcggctttttggccatgctctcttgcaccttgcccgttgccttgtccggtgatcgccccgtaacctgagtaaggcttgccgatttttcctgtgatcagcaccatgtttaagaagcctttcacagccgctgttccatcggtttgctgttcaatcccgcgggctgtaaacagcatgccggacgtttccttggcaaactttacagccgcttttcttatatccaccagggggacactcgtctgttcggcgatgtcattcaggtccaacgagtcagtatactgcttcagctcttcgaatccatttgttcgtgattgaatgaaatcctcgtttataagctgttcgtcgatgatgattttgacgagaccgttggcaagagcggcgtctgtgccgggtttgattttcaaatgaagatcggcgatttttgttgtcgctgtttcacgcggatcaatggcaatgatgtaagctccgttttctttcgctttttcaaaatatggcataatcgtaggctggcactccgcgatattggtgccggccagaatgatcacacgggtgtggggaatgtctgataagggattcgttaagcctctgtccgcgccgaatgtttggttggctgcggttgctgcggcggacatacaaagcctcccgttgtagtcgatgtattttgtctgtaagcccacccgtgcgaatttccctaacaaatacgcctcttcatttgtaatcgaggcgcttccgtataccgccatagcgtcatggccgtgttctacttggatcattgtcacttggtctttaatgtaattcagtgcttcttcccaggaaacaggcataaactcgccgtttttcttcagcagcggccgggtgatgcgggaggagttcagggcatgctggtgggcgttcatgcccttcatgcatagccgaccctgtgttgtaggattatcaatcccgatcgcagtgtactttttgcgcgtgacgatggtttgttccacgagctgcattttgcactgcatgctgcaaaacgggcattgagtgtcatatgttttttctgattggacgtcttgctgtttatcacggaaatatctaagcagtcgttcagtcaaaatgcctcatcctttcttatatgcacccgtctctacagtcgggttttgaatcagtgacagatctgtttggaggctttccagcagctgggcccttaggtcttcttcgaatagcacttctctgatatgaacgatcccgagacggtctatccactgatgaacaccttctaagtaatgagccgtttcccgataatactggatcagtcctttgatcatgccggcagtgctgtcttcgttctcagtcacgcaaaacaaagctcctgaacgggcatgagttccccggacgccgccgatgtgaatgtcccagccagcttgtgtccgaattgcgccgacatcttgcagggcggcatcggtgcagtctgtttcacatgataagctgatagaaatgggagcgggtaagggaagcatctcaagttgtctttcgatttgggctgccagctgctgaattgatcgattttgcccgcatgtacatgctttgatgctttgcagcgcgtgtcggtgttcattagtgtaaacgggcatcttcaggtctttttttatgttcgggagatccgcaggcttgatcccggaaagcttcagcctttggccgtgagtgatggatacgtcgggaatgctgtatgcctcaatgatgttggcgatggttcttagttgctccgcgtttgtccgcccgccgtacatttgcggaatcaggatgcatgtctcttcagtggctggctcaggctggacaaacccggggtacagcatttccagatagtattgaatcgcaggaacacaagtactgcatccttttttttctccagtcaagctggtccatcacttctgccggattagtgaatggcctgcgctgaagctcagcgatgatgtcgtcttctgtaaaatcagtacagctgcaaaacgaaggtgtgccggcgggcttcgtatattcgctgttggtcatgtgcctcaaaaggtcttcaacgagcggtttgcatcctccgcaggacccagaggctttggtgcagtgcttgacttcctcaacagttgttaagcttttcgtgttcaccgcatcttcaatcgcgcctttcgtcactgtgttgcattggcaaatcgtttcactggaaggcatggattcaaataaagtgccgcttgtctccggttcgatgatctgctttttgacaatggagatgtctcgttgtttaagcaggctgtcgagaagccgctgcttgtcacgggtgtctccgaataaaataacgccggccagtttttcatctacaaaaagtgcttttttataaacgcctgcttgttcgtcgtagattttgatgctcgtcgtgcgttcatcctcttggatctttcctgctgaccacacatcgattccagctatttttaacgccgcagatggtgctgagccttgatattcctcacatggaacgccgcaaatatgactggcgagaacttttccctgctcataaagcggagccaccaatccgtacaccgttccgttatgctcagcgcattcaccaacggcgtagatattcggttcgcttgtctgcatgaagtcattcacgatgatcccgcggttcactttgattccagcggatacagccaattcaatattcggtctgacgccggccgccatcacaatcaagtctgcttttaatgaagagccatctttaaaatggattcggtctgccttcgtggtgccggaaatggagacggtgtctttctccaaaagaaaggttaggcctttttgttccagctctgtttgcagcagccgcgccgctgtttgatcgagctgtttttgcataatgccggcggagtggtgaatgacgctgacatccataccgagatgctgtaaaccgactgcagcttccagtcctaataagccggctccgattaccgcagccttttgaaagtgctgggccatgttcatcagcgcttggcagtcttctattgtccgaaatccatagacacctttttgtctgccccggggatagggagaatatgaggggaggagcctgttgccactattaatttgtcatacgacagagtgcgtttccgatctgtgatgacctgctgctgatctgtatcaatttgaataaccgtttcgcctgtgtaaagcgtgatcccgtgcttgtcgtaccaatccttgctgttcagtgtaatatcatcgagtgacgcttcaccctgcaatacagaggataagagaatgcgattgtaattgggatgccgctcgcttccgaaaatgacaatctcaaacatgtggcgattcagctttaatacttcttcaatacagcggattccggccatgccgtttcccgctaacaccaatctttgtttcttcatgtatcagacctcctttggcgaagctcgtaagttttctcctattaaaaattatgtcacaatgcactgttaacgcattaaacgtgtcacaaaaacttacacatgtcttttccagaaaataagggtcctatatccttgattcagaaaatgtaaaataatgagggtctagaaaggggaatcttatgaagctgtcggaactgaaaactagcggtcatccactcactttgctctgttcctttttatactttgatgtcagttttatgatatgggttatgcttggggcgctgggtgtttatatttctcaggattttggcctgtctccttttgagaaagggcttgtcgtagctgtgccgattttatctggatcagtgtttcgtatcattcttggtattttaacggacagaatcggaccgaaaaaaacggcagtgatcgggatgctggtgacgatgattccgctgctttgggggacattcggcggccgttccctgactgagctgtatgccatcgggattctgcttggcgtggcgggggcaagctttgctgtagcgctgcctatggccagccgatggtatccgcctcatttgcaggggcttgcgatggggattgccggagcggggaacaacggcacgttgtttgcaaccctgtttggccctcgtctggcagagcagttcggctggcacattgtcatgggaattgcgcttattccattattgatcgtctttattctttttgtatccatggcaaaggattctcctgcacagccgtctccccagccgctcaaaagctatctgcatgtgttcgggcaaaaggaaacatggtttttctgcctgctgtacagcgtcacatttggcggatttgtcgggctctcaagctttttatctattttctttgttgatcaataccagctgtcaaaaattcatgcgggcgacttcgttacattatgtgtggcggcggggagctttttccggcctgtcgggggcttgatttcggatcgtgtcggcggcacgaaagttctttctgtactgtttgtcatcgtggcactgtgtatggccggagtcagcagcctgccatctctctcaatggttattgttctattgtttgtcggaatgatggggctcggaatgggaaacggcgcagtattccagctcgtgccgcagcgttttcgcaaagaaattggcatggtgacgggaatcgtcggtgcggccggaggaatcggagggtttttcctgccgaacatcttaggatctctcaaacagatgacaggcacatatgctatcggttttatcacgttttcctgtatcgcgctgctggcgtttgcacttgtgcttgccgcaggctattactggcggaaaagctggagcgcggaaagcagcccggcggatgtttagggttttgacggacacgcgtttgtgcgtgtcttttttattttctcttgattttcaacagtgaaccgatcaaaataaatagtaattattacgatttgttagcgagaggagttttctgaatgaatcaacatacgctgctcccgaaaaaaacggagcgtcttcaatactttggatcggtcagtccggtcaaaggcgagaaaccagtggaaaaagagaaaatgaaggacctgcaaaatatcaggaaggattatttttttgatattcagcatgtaggtgtcgctaatgtgtcccatccagtcacaatcacttctgccatgatgcctgccgagcaaacaacggctgcgaactttacaatgacttgtaatttgccgagaaatcagaaggggattaacatgagccggttaacagagctgctgcaagtctatcatcaaaatggctgggttctctcattttcctctcttcagcaatttacgaaagagcttgcagaaaacatggacatatcatctgccacagttgaagtgaggtttccgtggtttttcgaacggaaaagcccgaagcttgagaaagcgggtttgatgcatgctgatatattcatgtctgtcacctatcgcaaagatcagccgtttaaacagcgtgccggcatctcagcaaaagtaacgactctgtgcccttgctccaaggaaatcagcgaatacagcgcccataatcagaggggaacggtcagcatttgggcggatattcacccggccgcatcgctgccaagtgatgttaaagctgatttgctttacgccgcagaatcaaatgcttctgcgagactgcatccggtattgaagcggcctgatgaaaaagccgtgacagaaacggcctatgaaaacccgagatttgttgaggatctcgtccggctgattgctgcggatttgtttgagcttgaatgggtgtcagcctttgagattgaatgccgaaatgaagaatcgatccatctccacgatgcctatgcgaagctgtgtttttcgaaggaagtggataaaatatgaaactctcattattcattgttgcagttcttatgccagccatcctgctgtcagcctgctccgatcatgcagaagaacacgcaagtatcaatacaaagaaaacggtcgaaaacataacggacgttcgaaaaacagcaaaaacaagcattgattggacaaagccttcgggcggagagtacccggatattaaacagaagcatgtctggattgatgtgaatgtgaaggagcagaaggcttacatcaaggaaggaagcaacaccatctatacaatgatgatctcttctggtcttgatcaaacaaaagatgatgctacgccaaagggcaccttttatgtagagcctgaacggggagaatggtttttctccgaaggataccgggaaggcgcagaatactgggtatcatggaaaaatcacggtgaatttctatttcatagtgtgccaatgactaaggatcaaaaagtcatcaaaacggaagcagaaaaactaggaacgaaagcatctcacggatgtatcaggctgaccattccagatgcgaaatgggtatatgaaaatatccctgaacatacaaaagtagtgatcagctgaattgaaaaccgttgacaaaaagaaaaaaaggccataaaatttaaatcgtaataattacgttttgtgataaatggcttatcattggctgtatctgtgaaaagcggaaaggctaaggatcttgctgtcattgatccccatgagcgtctcttgaaaactggaaacgaaacccaagctactttctgatgagatatttgcgctttccatcggttcagcaacgcaagtggagcaattgccctatgaagctgctgttttccgattgtcggcaaggatttgcgatggggaaaaaggattaaacgcggttggagcctttacggatttagaaatcgggtggaagcgagaaatgagcgcgaaaagctgctctacaccattgtacatacggcgaagtattcaatttaaatcgtaataattctatttttatggaggcactattatgaaaaaaattccggttaccgtactgagcggttatctaggtgcgggaaaaacaacattgctgaacagcattctgcaaaatcgcgaaggcttgaaaatagcggttatcgtaaacgatatgagcgaggtgaacattgacgtgggcttggtcaagcaggaagggggcctttccagaacagatgaaaagcttgtggaaatgtcaaacggctgcatttgctgcacgcttcgcgaagacttattaattgaagttgagaagctggcaaaagacggacggtttgattatatcgtcatcgaatcaacaggaatcagcgaaccgatcccggtggcccagactttctcttatatcgatgaagagatgggaatcgatcttacaaaattttgtcagctggatacgatggtgacagtggttgatgccaaccgtttttggcatgattatcagtcaggtgaaagccttctggaccgcaaagaagcattggggaagaggatgaaagagaaatcgccgacctcttgatcgatcaaattgagttttgcgatgtactgatcttaaataaatgtgatttggtcagcgagcaagagctcgaacagcttgaaaacgttcttcgtaaactgcagccaagagccaggttcattcgttccgtcaaaggaaatgtaaaaccgcaggagattttgcatacagggttatttaacttcgaggaagcgagcggatcggccggctggattcaagagctgacggcaggccatgcggaacacaccccggaaacagaagaatacggtatctcttcatttgtatataagagacgtttgccgtttcattctacacgattttaccgttggctggatcaaatgccaaagaacgtggtacgtgccaaaggaatcgtctggtgcgcatctcataacaaccttgctttgctgatgtcgcaagcaggtccgtcggttacgattgagcctgtatcttattgggtggcggcgctgccgaagcttgagcaggagcaagtcaaacagcaggagccggaaatcctggaggagtgggacccggagttcggtgaccgcctaacgcagctagtttttatcggaactgacctggatgaagaaacgattacgaaagagcttgatcaatgcctgctgactgaatatgaatttgattccgactggtcgctgtttgaggacccgtttaaatggaagctgaatcaatagaaaaaaagccgtcccctggggcggctttttttaatgaaacgtttgtttaaacataatgagcgtattttttctcaaggatattctgaaagaccgcggcaatggagcagatggcccaataaatgagagcggtcagaatatacatggtcatataatcaaactctctgcccccgatgattttcgcatgctggagcaattccggcactgtaatcatcgcagcgagagaagatgccttgattaagtcgagcaatacattggcaagcggaggcagcgcaatacgtatcgattgcggcaaaatgatgcccctcatcgtctgccaataggaaagacccagcgaggatgcggcttcccactgtcctttttcgacggatgaaatggctgaccggttaatttccgcaatgtaggcggcgctgtttaggctaaagccgattaaagcagccgtgacagcggaaaattcaatgccgatataaggaaacccgaaataaaggataaacaaaatcaccaaaatcggaacgccccgcataaatgagatatagagcttcgccggccatcttaacaaagcaagctttgacattctggcgagtgatatgaacaggccgatcacagttcccgcaaacatgcttacaaaagagatgagcagtgtatacccaatgccttttatgacataagggaacgattcaatagccagcttcgtgttgaaaatatattcccattgaatgctattgatcatggcgtccgattacaaatcaacgtcctgaacgtcggcatcaattttttttgatacatctgctttattgaagaattgtttcgacagtttagtcaaagagccatccttgctcatctctttcaatgcttcgttcatctttttctgaagtgcctcattgctttttttcatgacaagggcctgtttgttcggcatgtacttgatgtcaggatgaattgtaatgttgagatccgggaatgccgcgagcgcaagtgtctgcaggtaatagtcgtttaaaatgacgtcagtgcgtccgttggcaacatcttttaaatattgctcattcgtcgcattatcataaatcacttctttggcgccgtattttctcgcgacctccatgtagacggttgtagccgcgccagccgctttcttcccttttaaatccttaagcgttttaatccctgataaatcgtcttttcggacaattgccgtaccgtatgaatatttatatggagtagaaaatgcgaacttcttctcgcggtccttcgtcacatcgatgtcattcgcggctgcgtcaacctgtccgctgttcaccgctgtcagcatcccgtcaatgcccatctccttgaactcaaccttcagtcccaggcgttttgccgcttcacgaacgacttcaacctcgtagcccgtcagcttatcggagccagagtcggtatcatgataagaagtgggataaagcgtgcctgatgtagcgactacgattttccctttatccttaatctgctcccagcctgtatccttggaatcggcttcatttttgccggaacaggctgccaatataagaaagaaagccattgtgaaactgaatataacggctttggaatgcatgaatgatttcacctatagttcccccaatctgttaatcaactaaaaagatagcattgaacataaggggttgcaatatgttgatcgcgttttcaaaaagttcgaattgtgtatacaaaaggcatgtgtgggtgtttaaaagcgtctatgaagggaagaggtgatgaaaaaaggagttgtccaaggatgaatgccagacgtaccaaggaaacgcatgtgaaagtgaaggatgcagcagacccgtcactcatctatgccaataccggaagaaatggtcaagagacatgaaaccgatcttcagaataatttaagtcttgctgatgcccctaaggcatatgatatattcgatgagaaagaaaatggaaacatttaaaccataatggggagtcaaatgaacatttacaaaccagctggattttggatcagacttggagcagcattgttagactacattatagtctccgtgcctcttttgctgatctattggctgattacaggaaaagacccgaatgacagcatgttcatcagtttggttgttctgctgtactctattttgctgccggtgttttggcgcggctaccttatcggaaaaagaatctgcggaatcagaatcgtaaaaaaagacggatcacaagtcagcttgttaacaatgtttttacgggttattgtagccggcctggtttacgttataaccttcggactcggcttgatcgccagcctgattctgattgccgtacgagaagacaaacggaccctgcatgatttaatcgcgggaacgtatgtcacttatgcgacgccaggtgaagaagaacttaatgctgacgaagagattagaaagagcgaataatggttcgctctttttatttttatgcataaaaaatacaaggcagcaaaacatatgaaaaatagattggaggaataaactggatgaaacgaataaccatcaacatcatcacaatgttcattgcagcggctgtcatttctctgaccggtacagctgaggccgctgaaaaacagcagcagcctcccgcaaatgttacactgacagatcagcaaaagaaagagattgaacaactggaagcagagattcttaaaaagcgcaaagacgtgatctcaaagtatgtacaatatggtgtcctgcctaaagaaagaggagaacacatcaaaaatcacttggacaaacactttgaaatgatgaaacaaaacggctttgttccaaagcaccatcctcatccgcataaatttgaaaaaagacattaagattttaagcatccaatgggaattgggtgcttttgcgttatttacaggtaggcaatattagttgagctgttccgcgactaacatcgagttgatatgaaacgcgtttcatagcctatgataggtttatcaaataattcaggagtgataaacactatgatccaccggcatccagaatcttttccgaaacattttttgtggggctctgcttctgcagcgtaccagattgaaggcgcttggaatgaagatggcaaaggcccttctgtttgggatgtgtttacgaaaataccgggcaaaacgtttaaaggaaccaatggcgacattgcggttgaccattatcaccgatttaaagaagatgtcgctctgatggctgagatggggttaaaagcatatcgattttccgtcagctggccacgggtttttccaaaaggaaaaggagagatcaatgaagcaggtctagcgttttacgatagactgattgatgaattgctttctcatcacatcgagccggttctgactttatatcactgggatttgcctcaagcgcttatggacgaatacggcgggtttgaatccagaaacatcatagaggattttaatcactactgtattactctttataaacgttttggagacagggtgaaatattgggttacgttaaacgaacagaactacaattttaatcacggatttattacagccatgcatccgcctggagtgaaagacagaaaacgattttacgaagcaaaccatattgcgtttctggctaatgcaaaagccatcgaatcatttagagaatatgtgcctgaaggcaaaataggtcctagctttgcttattctccggcttaccctttatcaagccatccagaggatatactggcatttgaaaacgccgaagaatttacgaacaattggtggcttgacatgtattgctggggaacctacccgcaaattccattccgctacttggaaaaacagggatgggcgccgacaattgaagcagaggatatggacctgctcgccaaagggaagcctgattttgtaggtgtcaattattatcagacgatcacctatgaacgaaatccgcttgatggtgtgtcagaagggaaaatgaatacgacaggccaaaagggaaccaatcaggagacggggatacccggagtgttcaaaacgaaaaaaaatccgcatctgacaacgagcaactgggattggacaattgacccaattgggctgcgtatcggtcttcgccgaataacaagccgctatcagcttccagtgtttataacagagaacggtttgggtgaatttgataaagttgaggacggcactgtacaggatgattatcgaattgattatttgcgttcgcatcttgagcaatgcagacaagccatcagtgacggtgtcgatttaatcggctattgcagctggtcgtttactgatctgttaagctggctgaacggctaccaaaaaagatacggatttgtatatgtcaatcgtgatgaagaaagcacatccgatttaaaacgcttgaagaaaaaaagcttttattggtatcaagatgtcattaagacaaacggagaaagtttataaagagtccctgagagttattctctcaggggtttttcattacacagaaacagcatcaataatataagtgtcggcgtgcaaatctgacatttcagccggcacagtccagcatgtcaattgatagtctcctttaggcagatcaaaggacagtcttttagacatgatgctttcaatatgaattccgttttctgtgacatgaaaaggaacagtcacttttttttcgtaggagtttactgtttctgaactgttcaggcgcaaaagaataaaggcctttgtatttcgctgtgcctcaaaggaaatggctccgtctgccgcagcatatcctttttcaatcgcttcgtcagtccaatccattacaggaggtgtagaatccttttgaaatacagtaaattgatgatatgaaatcgaaagttcttgcggcttccatgatttgatcaatgtgctgttcctcctctatgtactgtttactgaattgtgaataaaacctttgtgccgtctgggtaatcggtaagctgatgcccgacccaagagcctgctccgcggttgtcagcgggagaaatgtattctacagaagctccctcaccgccttctttgcacatggccattggccattcatctctgtcatacccctttttggaaggtacgtcctttaatgattgctcgcggcgttcctcagctccgtctctgtcgatagtgcacacctctgagtgcccctcatttatcgcatccttaatatgcttggccgtttcgggataacggtcagaagggaaggcgattgtttcatcatattctttcgtttgagacgttttttgatcagctgagaaaaagtctccttttatcaggccgacagctgtagctgctatgatgacgatgacgagaagtattgtttttatgatgtccgtcgtgatgttcacctcccgcttttaaaactgacacaagagtaatccagaaagcatttggtgtaaaggtttaaattttatgttttacgctcagtttattgcagaaatcgtaattttagcagatcgaaatatttgttttcagcaaaatacgattgccaatttacaataatgatagtaagtcatcagccgttttcggcttgattaatcattttaaattggcttatgataccggtaagctcctcagctaattgagaaagtgtttcagaagctgcggtaatctcctccattgcagcaaattgctcctctgttaatgcagccgcttgccgggtatttttagtagattctttaatgtcggccgtattggctgcaaaggaatcatttatttgatgtgcactggctgaaatgtttgttacagatgctgataaatcactaatctcggcgctgatttcacctgttgcagctgcaatttccttaaatgcatctctggtgcgctggatcatggtgactccttctgcagcttctgttttcacatgctcaacagatcttgcagaccggttcatatccttttgtatttctatgatcagttttgaaatctgccctgcagattgttgagactcttctgctaatttccgtacttcatcagcaacaacagcaaagccttttccttgttcaccggctctggcagcttcaatcgctgcattcagcgcaagcaggtttgtctgatcggcaatttgggtgatgaccgataaaatttgctcaatttgtttagagcggccgtctaactggtgtatgatttctccgcttttctgaattgactggtgaatcgcatccatttgcgcctgtacatttgcaatttccttttgtccaatgtctgcttttgattgcgcgagctgccctttgtcagcgatagcggcagtatttgcagaaatatcccggatgtctgctgaagcttgttttaatgagctttcactgttttcaattcgggtgatctgatcttgggctccatttgcaatctgctgtacagcttctgtgattttttctgaagcttgatttgtttcctctgctccggctgagagctgctgagaggctgacgcaagctgaagggctgattgttgtacggtttgtatggtatcgttcagcttcattctcatcttattgtaatagacgcttagttctgatagctcgtcaccggttttgtctgacacctctattgtcatatctccgtttccggcactttcaaaggcgctttttaaagcgttcagccgcttgttgatttttctggtgaaaaccaaaacaaggatgactgatactataatgacgataacaagaacgatagcgaattgagtgaaaagtgattgtgtaagtgatgctaaatactttgattagctccggtatacagcatgccgatgatgttcccattttgatcttttaacggcatgtatgcagtctgataagaagaacctgctacatctgcttgtccgtaaaaacgctttcctttctttaaaacagcggcaataacttcagaagaagcctgggtgccgacagctctttcgccattcttcatgacattggttgcaacacgagtatcgccttggaaaatggtaatggtatcacctgttttttcaccaagcagatcaacaatatcttcatttccattgatttgtgtttgccctttatagagcttattgtttttcacctgccagtcgcctgacatgacatcatcaatatatgtgctgcttaaagcgagatcacctttcgctttttcagttgccatttgtttcatgctttctgtaatttctttaagcatcacagtgccaactgatgccgaaaacaaaagaatcaccacgaaaacgaggcaaagaattttagttcctagcttcatcttaaatcgttttatcaacataattcctccttttatgatttataggtcatattacttatcgggtttttgggtttaaagttttatttttaaaaaaataaaaccggcctgattttcaggccggttgtgtgatgctattcaaggtttgcgtggtgagtgaacatagtttcagaatcgagtgcttttttctccatgagttttaaaatcactgcatcatagaagagcagcaaagtttgttcaaataatgatcccattggctgaatggttttatagcttccgtttgactggtctttaggagaaccaggcattctgatgatgaggtccgcttgttttccgatgcttgattccggattgatggttaaagcggcaacaattccgtgtaagctttttgcttttgctgcggtatgaatcaagctctttgtctcgcctgatcctgagccgataataactagatctccttcggcgagcggcggagtgagaatctcacctactatatgggcgttgaagcccatgtgcatcaatctcatcgcgaaggattttgccatcaggccagaccgccccgcacccgcagtgaaaatttggtgggatgaaagaatgtgatcggcaagctggtcagcctcttcattagaaatataagctgctgaacggtgtaactcattgagaatttccgctacgtattcagtcgttttcatcggagttatccttggacaatcagctgcttcatttttgaagctgtttccgccttatcagctgcgcttgtaattccgcccccgacaatgacaaggtcaggcttttgctggatcacttctggtagtgtatcaagtttgatgccgcccgcgattgcggtttttgcgttttttacggtgtttttgattgtcgttaattcttcgaaagagttcttgccctctgcttgaagatcatagccagtgtggacgcagatgtagtcaacaccgagtgcgtcaatttcttgcgcacgggtctcgatatctttcacgttaatcatgtccactaagattttcttcttttgttttttggcttcttctactgcgcctttaatcgttgcgtcgtctgtagcccctaaaacggtgatgatgtcagcgcctgcttccgacgctttcataatttcgtagcctccggcatccatgattttcaggtctgcaagaaccttcaattgaggaaatgcttcttttatttctttaacggctcttaggccttcattaatgacgaccggtgttccgatttcaactacgtcgatgtattgttctacctctttgacaagctcaatggcttctggaatgttgacgaggtctaatgcaagctgtaattccattgttgatccactccctttttcgaattattgttcattctataggttccctcttttgttgagaagtaggcactttgaagtcaacaagttacttggaggatactgtgaggagaggcaatcagatttctttcgcttgattttatgagtgagtataatgaaaaaagagtctgcaaaaaagtaagtaagtgatgatacgtatctaacatacaaaaaggttactaaggggggggattctattgagccggatggacgacaaaaggtttaattgtgagaaggaattaacgcttgcagtgattggcggtaaatggaaaatgctcattttatggcatttaggaaaagaaggcacaaaacggttcaatgaattaaaaacattgattcctgatattacgcagaagatcctcgtgaatcagctgagagagcttgagcaggatatgattgttcacagggaagtgtatccggttgtcccgccgaaggttgaatattctctgaccccgcacggagaaagcctcatgcctattcttgaagccatgtatgagtgggggaaaggctatatggaattgattgatatcgacaaaaatgtcatgaaagaatcgttgtaagacgctcttcgcaagggtgtctttttttttgcctttttttcggttttttgcgcggtacacatagtcatgtaaagattgtaaattgcattcagcaataaaaaaagattgaacgcagcagtttggtttaaaaatttttatttttctgtaaataatgtttagtggaaatgattgcggcatcccgcaaaaatatccctgtaaataaactggaatctttcggcatcccgcatgaaacttttcacccatttttcggtgataaaaacatttttttcatttaaagtgaacggtagtaagataaaaaatattgaaaacaatgaataaatagccaaaattgtttcctattaggatagggaatcttgcggtctttatctgcttatgttaaacgccgcaatgctgactgatggctgcccgttttaatagcggcaatctgtttttttgtttggaagctctgctttttaagtgtagtactttgggctatttcggctgttagttcataaggattaaaagctgatatggataagaaagagaaaatgcgttgcacatgttcactgcttataaagattaggggaggtatgacaatatggaaataactttttaccctttaacggatgcacaaaaacgaatttggtacacagaaaaattttatcctcacacgagcatttcaaatcttgcggggattggtaagctggtttcagctgatgcgattgattatgtgcttgttgagcaggcgattcaagagtttattcgcagaaatgacgccatgcgccttcggttgcggctagatgaaaacggggagcctgttcaatatattagcgagtatcggcctgttgatataaaacatactgacactactgaagatccgaatgcgatagagtttatttcacaatggagccgggaggaaacgaagaaaccgttgccgctgtacgattgtgatttgttccgtttttccttgttcaccataaaggaaaatgaagtgtggttttacgcaaatgttcatcacgtgatttctgatggtatctccatgaatattctcgggaatgcgatcatgcacatttatttagaattagccagcggctcagagacaaaagaaggaatctcgcattcatttatcgatcatgttttatctgaacaggaatatgctcaatcgaagcggtttgaaaaggacaaggcgttttggaacaagcaatttgaatcggtgcctgaacttgtttccctgaaacggaatgcatccgcagggggaagtttagatgctgagaggttctctaaagatgtgcctgaagcgcttcatcagcagattctgtcgttttgtgaggcgaataaagtcagtgttctttcggtatttcaatcgctgctcgccgcctatttgtacagggtcagcggccagaatgatgttgtgacgggaacctttatgggcaatcggacaaatgcgaaagagaagcagatgcttggcatgtttgtttctacggttccgcttcggacaaacattgacggcgggcaggcgttttcagaatttgtcaaagaccggatgaaggatctcatgaagacactccgccaccaaaagtacccgtataatcttctgatcaacgatttgcgtgaaacaaagagctctctgaccaagctgtttactgtttctcttgaatatcaggtgatgcagtggcaaaaagaagaggaccttgcctttttgactgagccgattttcagcggcagcggattaaatgatgtctcgatccatgtgaaggatcgatgggatactgggaaactcaccatagattttgattaccgcactgatttattttcacgtgaagaaatcaacatgatttgtgagcgcatgattacaatgctggagaacgcgttaacgcatccagaacatacaattgatgaattaacgatgatttctgatgcggagaaagaaaagctgcttgcgagggccggcggtaaatctgtgagctaccgtaaggacatgacgatcccggaactgttccaagaaaaggctgagcagctttcagatcatccggcggttgtatttgaagatcgtacattgtcctatcgaacgttacatgaacaatcggcacgcatcgccaatgtgctgaaacagaaaggggttggcccggacagtcctgtcgcggttttgattgaacgctctgaacggatgattacagctatcatggggattttaaaagccggcggagcctatgtgccgattgatccgggttttcctgctgagcgcattcaatatattttggaggactgcggggcggacttcatcctgactgaatcgaaggttgcggcgcctgaagccgatggtgagctgattgacttagatcaggcaattgcagaaggtgcagaagaaagcctgaatgcagatgtgaacgcacggaaccttgcctacattatttacacatcgggaacaaccggacgtccgaaaggcgttatgatcgagcatcgccaagttcatcatttggttgaatctctgcagcagacgatttatcaaagcggcagccaaaccctgcggatggcattgcttgcgccgttccacttcgatgcgtcagtgaagcagatcttcgcgtcgcttcttttgggacaaaccctttatatcgtaccgaagaaaacagtgacgaacggggccgcccttgctgcatattatcggagaaacagcattgaggcgacagatggaacacctgctcatttgcaaatgctggcagcagcgggcgattttgaaggtctaaaaatgaagcacatgctgatcggaggagaaggcctgtcatctgttgttgcggacaagctgctgaagctgtttaaagaagccggcacagcgccgcgtttgaccaatgtgtacgggccgactgaaacgtgcgttgacgcgtctgttcatccggttatccctgagaatgcagttcaatcagcgtatgtgccgatcgggaaagcgctggggaataaccgcttatatattttggatcaaaaaggccggctgcagcctgaaggcgtggcgggcgagctttatatcgcgggagacggtgtgggccgaggctatttgcatttgcctgaattaacggaagagaagtttttacaagatccattcgtgccgggcgatcgcatgtaccggaccggggatgtggtgcgctggcttccagatggaacaatcgaatatttaggcagagaggatgaccaggtcaaagtccgcggataccggattgagcttggggaaattgaagccgtgattcagcaggcgccagacgttgcaaaagccgttgttttggcacgccctgacgaacagggaaatcttgaggtttgcgcatatgttgtgcagaagcctggaaccgaatttgcgccatccggtttgagggagcatgcggccagacagcttcctgactatatggtgccggcttactttacagaagtgacagaaattccgcttacgccaagcggcaaagtcgaccgccgcaagctgtttgcactagaggtgaaggctgtcagcggcactgcctatacagcgccgcgaaatgagactgaaaaagcaatcgcagccatttggcaggacgtgctgaacgttgagaaggcggggatttttgacaatttctttgaaacgggcgggcattcattgaaggccatgacccttttaacaaagattcataaggaaacaggcatcgagattccgcttcaatttttgtttgagcatccgacgattgcggctcttgcagaggaagctgatcacagagaaagccgggcattttcggtgattgaacctgctgaaaaacaggagcattacccgctttcattggcacagcagcgaacatatatcgtcagccaattcgaggatgcaggagtcggctacaacatgcctgcggcagcaattctggaagggcctttagatattcaaaagctggagcgcgcatttcaggggttaatccgacgccacgagtcattgagaacatcatttgttcttgaaaacagcacgccgagacagaacattcacgacagcgttgaattcaacattgagatgattgaaagaggcggccgctcagatgaggcaattatggcttcattcgttcggacatttgatttggcgaaagctccgctgttcagaatcggtttgctggggcttgaagagaaccgtcatatgctgctgtttgatatgcaccatttgatttctgacggtgtatccattggcattatgctggaggagttagcacgcatttataaaggcgaacagcttcctgaacttcgtctccagtataaggactacgctgtatggcaaagcagacaggctgctgaagggtacaagaaggaccaggcttattggaaggaagtctttgcagacgagctcccggtgcttcagcttctgtccgattacccaagaccgcctgttcaaagctttgaaggggatcgggtgtcaatcaagctggatgcgggggtaaaggatcgcctcaatcgtttggctgaacaaaacggcgccactttatatatggtgatgctgtccgcttactatacgcttttgtcaaagtatacgggacaggatgacatcattgtcgggacaccgtcagcgggcagaaatcactccgatacagagggcattatcgggatgtttgtcaatacgcttgcgattcgcagtgaggtgaagcaagatgagacgtttacccaattgatctcgcgtgtccgcaaacgggtgctgaatgccttttctcatcaggactatccgtttgagtggcttgttgaagatttgaacatcccgcgtgatgttagcaggcatccgctgtttgacacgatgttcagccttcaaaacgcgacagagggtattccggctgtcggcgatctgtccttgtctgttcatgagaccaatttcaagattgccaaatttgatttgacggtgcaggcgagagaaatcgatgaaggcattgagcttgatttggattacagcacgaagctgtttaaacaaagcacggcaaacaggctgcttacgcattttgcgcgtttgcttgaagatgctgcggctgatccggagaagccgatttctgagtataagcttctttctgaagaggaggctgcttcgcaaattcagcagtttaacccgggcagaacaccttatccgaaagacaaaacaattgttcagctgtttgaggagcaagcggcgaaaacaccagaccatccggcgcttcaatatgaaggcgaatcactcacttatcgtgagctgaatgaacgggccaatcgtttagcccgcggcattctttctcttggggctggcgaaggcaggacagcggctgtcttatgcgagcggtcaatggatatgattgtgtcgatcttggcagtattaaaatcaggttcggcttatgttccgattgatccggaacatccgatgcagcggatgcagcatttcttccgtgacagcggagcaaaggtgcttctcactcagaggaaattaaaggctttagcggaagaagcggaatttaagggcgttatcgtgctagccgatgaggaagagagctatcatgccgatgcgcgcaatctcacactgcctcttgattctgaagcaatggccaacctgacgtatacctctggaacgactggaacacctaaggggaatatcgtgacacatgccaatattctccgcacggtgaaggaaacgaattatctcagcattacagaacaggatacgattctcggtctttccaattacgtgtttgacgcgtttatgttcgatatgttcggatctttgttaaacggagccaagctggtgctgataccgaaggaaaccgttttggacatggctcgcctgtcccgcgtcattgaacgggagaacatcagcattctcatgattacaaccgctttgttccacttgcttgtggacttgaatccggcgtgcttgtcaacgcttcgcaagattatgtttggcggggaacgggcttcggttgagcatgtcagaaaagctttgcaaacggttggaaagggcaagctccttcacatgtatggaccgtctgaaagcacggttttcgcgacgtatcatccggttgatgaattggaggagcacacgctgtctgttccgattggaaaaccggtcagcaatacggaagtatacattcttgacagtacgggacacgtgcagcctgccgggattgccggagagctttgcgtcagcggcgaaggactcgtgaaaggctattacaaccgtccagaactgactgaggagaaatttgttccccatccgtttacatccggcgaacgcatgtataaaacgggagaccttgcgagatggctgccgaatggcgacatcgaatttatcgggcgaatcgaccatcaggtgaagattcgcggacagcgcatcgagcttggagaaatcgaacatcagctgcaaacccatgatcgtgttcaggaaagtgttgtgcttgccgttgatcaaggagcgggagataaactgctttgcgcttactatgtcggagatggagacatctcatcacaagagatgagagagcatgctgcgaaggacttgccggcatatatggttcctgcggtgtttatccaaatggacgagctgccgctgacagggaacggaaaaattgaccggagagcgctgccgattcctgatgccaacgtttcaagaggtgtttcatatgttgcgccacgcaatgaaacggaacaaaaagtcgcagacatttgggcacatgtgcttcaggctgaacaagtcggcgcttatgaccacttctttgacattggcggacattcattagcaggcatgaagatgcttgccttggttcatcaggaactgggcgttgagctgtcactcaaggatctcttccagtcaccgacggttgagggcttagcacaggtgattgcctctgctgaaaaagggacagccgcaagtatcagcccggcagagaaacaagatacgtatcctgtttcttcaccgcaaaaacggatgtacgtgcttcagcagcttgaggatgcgcaaacgagctataacatgccggcggttctgcgcctgacaggtgagcttgatgttgaaaggcttaacagcgtcatgcagcagttaatgcagcgtcatgaagccttgagaaccacgtttgaaataaaagatggagaaacggtgcagcggatctgggaagaggctgagtgtgagatagcctatttcgaagccccggaagaagagagagagcggatcgtttctgagtttattaagcctttcaaaatcgaccaacttccactgttcagaatagggcttatcaagcattcagacactgagcatgtgctgctgttcgatatgcatcacattatttctgacggtgcgtctgtcggtgtgctgattgaagaactttcaaagctgtatgacggagaaacccttgagccgctccgtattcaatataaggattatgccgtgtggcagcagcagttcattcagtctgagctttacaagaagcaagaagagcattggctgaaggagctggacggagagctgccggtgctgacgcttccgactgattacagtcggcctgccgttcaaacatttgagggagaccgcattgcattttcattagaagcaggcaaagctgatgctctgcgcaggcttgcaaaagaaacggattccacgctttacatggtgcttctggcttcatacagtgcatttttatcaaaacttagcgggcaagacgatatcatcgtcggttcacctgtcgccggacgatctcaagcggacgtcagccgcgtcatcggaatgttcgtcaatacattggcgcttcgcacgtatccgaagggtgaaaagacctttgctgactatcttaacgaagtgaaagaaacggcactcagcgcttttgatgcgcaggattacccgcttgaggatttgatcggaaatgttcaagttcagcgtgacacaagcagaaacccgttattcgatgcagttttttcaatgcaaaatgcgaatataaaggatttaacaatgaaagggattcagcttgagccgcatccgtttgaacggaaaacagccaagtttgacctcacgctgacggctgacgaaaccgacggagggcttacattcgtactcgaatacaatacagctctgtttaagcaggaaacgattgaacgatggaagcaatattggatggagcttttagatgcagttactgggaacccgaaccagccgctttccagcctgtcactggtcaccgagacagaaaagcaagcgcttcttgaggcatggaagggcaaggcgctgcctgtgccgacagacaaaacagttcatcagctattcgaagagactgtccagcgccacaaagaccgcccggctgtcacatacaacggccaatcttggacgtacggcgagctgaatgcgaaggcaaaccgtctcgcgcggattctgatggactgcggcatcagcccggatgaccgcgtcggcattctcacgaagccgtcgcttgaaatgtccgccgcggtgctcggcgtcttgaaagccggagcggcgtttgtgccgattgatcctgactacccggatcagcggattgagtatattttacaggacagcggcgcgaagctcctcttgaaacaggaaggcatttcagtgccggacagctatacgggagatgtcattcttctcgacggaagccgcacgattctaagcctgccgcttgatgaaaacgacgagggaaatccagagacggctgtaaccgcggagaacttggcgtacatgatttacacgtctggaacgaccggacagccgaagggtgtcatggtcgagcaccatgcgcttgtgaacctgtgcttctggcaccacgacgcgttcagcatgacagcggaggaccgcagtgcgaagtacgcgggcttcgggttcgacgcttccatttgggagatgttcccgacctggacgatcggtgctgaacttcacgtcattgatgaagcgatccgcctcgatatcgtccgcctgaacgattattttgaaacgaacggcgtaacgatcacgttcctgccgacacagcttgcggaacagttcatggagcttgagaacacatcacttcgcgtcctcttgaccggaggagacaagctgaagcgcgcagtgaaaaagccgtacacactcgtcaacaactacgggccgacagaaaatacggtcgttgccacaagcgcagaaatccatccggaggaaggctcgctttccatcggaagggccattgccaatacgagagtatacattctcggcgagggcaatcaggtgcagccggaaggcgtagccggagagctttgcgtggcggggcgcggactggcacgcggctatctgaatcgagaaggcgaaaccgcgaagcggtttgtcgctgatccgtttgtgccgggtgagcgcatgtaccgcaccggcgatttggtgaaatggacgggcggcggcatcgaatacatcggccggatcgaccagcaggtcaaggtccgcggctaccggatcgagctttcagaaattgaagtccagctcgcccagctttctgaggtgcaggatgcggcggtgacagctgtcaaggataaaggcggcaatacagcaatcgcggcgtatgtcacaccggaaacagctgacatagaagcactaaaatcagcactaaaggaaaccctgccggattacatgatcccggcgttctgggtgacgctgaacgagcttccggttacggcaaacggcaaagtggaccgcaaagccttgcctgacccggacatcgaagcgggaagcggagaatacaaagcgccgacgaccgacatggaagagctgcttgccggcatctggcaggacgtgcttggaatgtctgaagtcggtgtcaccgacaatttcttctcgcttggcggagattccatcaaaggaattcaaatggcgagccgcttgaaccagcacggctggaaggtggaaatgaaagatctcttccagcatccgacgatcgaggagcttacccaatatgtagagcgtgccgaaggcaaacaggcagaccaaggcccggtagagggcgaagtcatcctgacgccgatccagcgctggttctttgaaaagaacttcacgaacaagcaccactggaaccaatcggtgatgcttcacgccaagaagggctttgatcctgaacgggtggagaaaacattgcaggcgctgatcgagcatcatgacgcgctccgcatggtctatcgtgagggacaggaagacgtcattcaatacaacagaggtcttgaagctgcttcagctcaattggaggtcatccagattgagggccaagctgcagattacgaagaccgtatagagagagaagcggagcgtttgcaaagcagcatcgacttgcaggaaggcggcttgttaaaagcaggcttgttccaagcggaagacggagatcacttgcttcttgccattcaccacttagtggttgacggcgtgtcgtggcggattttactggaggatttcgccgcggtatacacacagcttgagcaaggcaatgaaccggttctcccgcagaaaacacattcatttgcagagtatgcagagagattgcaagacttcgcgaactccaaagcctttttgaaagaaaaagagtattggagacagcttgaagaacaagctgttgcggcaaagcttccgaaagaccgcgaatctggtgatcagcgaatgaaacatacaaagacaattgaattctcgctgactgctgaagagacagaacagctcaccacaaaggtgcatgaggcatatcacacagaaatgaatgatattttgctgacggcattcggattggcaatgaaggagtggacgggtcaagatcgagtaagtgttcatttagaggggcatggacgtgaagaaatcatagaagacctgaccatttcccgcacagtcggctggtttacaagtatgtacccaatggtgctcgatatgaagcatgcggatgatctgggctaccagctgaagcaaatgaaagaagatatcagacatgtgccgaataagggagtcggatacggcattctgcgctatatgacggcaccggaacataaagaagatgtggcgttctcgattcagccggatgtcagcttcaactatttaggtcagtttgacgaaatgtcggatgcaggtttgtttacgagatcagagctgccgtcaggacagtcattaagccctgaaacagaaaaaccgaatgcgctggatgttgtcggatatatcgaaaacggaaaactgacgatgtcactggcctatcattctcttgaatttcatgaaaaaacagtacaaacattcagtgacagctttaaagcgcatcttctcagaatcattgaacattgcctatctcaagacggtacggaactgaccccgagtgatcttggtgacgacgatttgacgctggatgagctggataaattaatggaaattttctaatagaggtggcatatgagcaaaaaatcgattcaaaaggtgtacgcactgacaccaatgcaggagggaatgctgtatcatgcgatgcttgatccgcattcttcctcgtacttcacacaattagagcttgggattcacggcgcttttgatcttgaaatctttgagaaaagcgtcaatgaactgattcggtcatacgatattctccgtacggtatttgtgcatcagcagctgcaaaaaccgcgtcaggtcgtgttagcggaacgcaaaacaaaggtgcattatgaggatatcagtcatgcagacgagaaccgccagaaagagcacattgagcgttacaaacaagacgttcagcgccaaggctttaacctggcaaaagacattttgttcaaggtagcggttttccgccttgctgcagatcagctgtatcttgtctggagcaatcatcatattatgatggacggctggagcatgggcgtcctcatgaaaagcctgttccaaaactatgaagcgctcagagcaggaaggacacctgcaaacggtcaaggcaagccttactccgactacatcaaatggcttggaaaacaggacaatgaagaagcggagagctactggagcgagcgcttggcgggttttgaacagccaagcgtgctcccgggccgcctgcctgtgaaaaaagacgaatacgtcaataaagaatattcctttacatgggacgaaacattggttgcccgtattcagcaaaccgcaaatctccatcaagtgacagggcctaacctatttcaggccgtttggggcattgttctcagcaaatacaactttacggatgatgttgtcttcggaacggtcgtctcaggaaggccgtctgaaatcaacggaattgaaacgatggcggggctgtttatcaacaccattccggtgcgggtgaaagttgaacgagatgctgcattcgctgatattttcacagctgttcagcagcatgcagtagaggcagagcgttacgattacgtgccgctctatgagattcaaaaacgctcagcccttgatggcaatctcttaaaccatctggtcgcgtttgaaaattatccgcttgatcaagagcttgaaaacggcagcatggaagaccgcctcgggttttcgattaaggtagaaagcgcatttgaacaaacgagcttcgatttcaacctgattgtgtatccaggcaaaacatggaccgtcaaaattaaatataacggagccgcctttgattccgcttttatcgaacggacagcggagcaccttacccgcatgatggaagcggctgtcgatcagccggccgcttttgtgcgtgagtacgggcttgtgggagacgaagagcagcgtcaaattgtcgaggtgtttaacagcacgaaagccgaactccctgaaggaatggctattcatcaggtgtttgaagagcaagaaaaacggacgccggcgagcactgccgtcgtatatgaaggaaccgagctgacgtaccgcgagctgaatgcagcggctaaccgtctggcgagaaagcttgtcgaacaagggcttcaaaaaggggaaacagcagcgattatgaacgaccgctcagtagaaaccgttgtcggcatgctggctgttttaaaagcaggcgccgcatatgtgccgcttgatccagcgcttcctggggatcgtcttcgtttcatggcagaggacagctccgttcgaatggttttgaccggaaattcttatacagggcaggcacatcagctgcaagtgccggttcttacactggacataggctttgaagagagtgaagcggctgacaatctcaacctgccatccgccccgtctgatttggcgtacatcatgtacacatccggttcaacgggcaaaccgaaaggcgtcatgatcgaacataaaagcattctgcgcctcgtcaaaaatgccgggtacgttcctgttactgaagaggaccgcatggcgcaaacgggagctgtcagctttgatgccggaacgtttgaggtattcggcgcactgctgaatggcgcagcgctttatccggtcaaaaaagagacgctgcttgatgcgaaacaatttgctgcatttctgcgtgagcaaagaatctcgacgatgtggctgacatcacctttattcaaccagcttgctgcaaaggatgcgggtatgttcggcaacctgcgccatttaatcatcggcggagatgcccttgtcccgcatattgtcagcaaagtaaaacaggcatcgccgtcgctttcattgtggaacggatacggcccgacagaaaacacaacgttttcaaccagttttctgatcgaccacgagtatggcggctctatcccaatcgggaagccgatcggaaattccactgcctatattatggatgagcagcaatgcctgcagccaatcggcgcgcctggtgagctttgcgtaggcggaatcggtgtagcgcgtgggtatgtcaatctccctgagctgacagaaaagcaatttctggaagatccgttcagaccgggtgagagaatttatcgcactggtgacttggcaagatggctgccggacggcaatatcgaatttttaggcagaatcgacaaccaagtgaaggtgcgcggcttccgaattgagcttggcgaaattgaaacaaaactgaacatggctgagcatgtgacagaagccgcggtgatcatccgcaagaacaaagcggatgaaaatgaaatttgtgcgtacttcacggcggatcgtgaagtggctgtgggcgagctgagaaaaacactatctcagtctttgcctgactatatggtccctgcccacctgattcaaatggacagtctgccgcttacgccaaacgggaaaatcaacaaaaaggaactgcctgcaccgcaatcagaagccgtgcagccggaatacgcagcaccaaaaacagagaatgaaaagaaattagcggagatctgggaaggaatactcggcgtcagagcaggcgttactgataacttctttatgatcggcggccattctttgaaagcgatgatgatgacggcgaaaattcaagagcattttcataaggaagttccgataaaagtgctttttgaaaagccgactattcaagaactggcactgtatttggaagagaacgaaagcaaggaggagcagacgtttgaaccgatcaggcaagcatcttatcagcagcattatcctgtatccccggcccagcggagaatgtatatcctcaatcagcttggacaagcaaacacaagctacaacgtccccgctgtacttctgctggagggagaagtagataaagaccggcttgaaaacgcgattcagcaattaatcaaccggcacgaaatcctccgtacatcgtttgacatgatcgacggagaggttgtgcaaaccgttcataaaaacatatcgttccagctggaggctgccaagggacgggaagaagacgcggaagagataatcaaagaatttgttcagccgtttgaattaaaccgcgcgccgctcgtccgttcgaagcttgtccagctggaagaaaaacgccacctgctgctcattgatatgcatcatattattactgacggaagttcaacaggcattctaatcggtgatcttgccaaaatatatcaaggcgcagatctggaactgccacaaattcactataaagattacgcagtttggcacaaagaacaaactaattatcaaaaagatgaggaatactggctcgatgtctttaaaggcgaactgccaatactggatcttcccgcggatttcgagcggcctgctgaacggagctttgcgggagatcgcgtgatgtttgggcttgataagcaaatcacggctcaaatcaaatcgctcatggcagaaacagatacgacaatgtacatgtttttgctggcggcgttcaatgtactcctttccaagtacgcgtcacaggatgatatcattgttggctcgccgacagctggcagaacacatcctgatctgcaaggtgtgccgggtatgtttgtcaacacggtggcactcagaacggcaccagcgggagataaaaccttcgcgcaattccttgaagaggtcaaaacagccagccttcaagcattcgagcaccagagctatccgcttgaggagctgattgaaaagcttccgcttacaagggatacaagcagaagtccactgttcagcgtgatgttcaacatgcagaatatggagattccttcattaagattaggagatttgaagatttcctcgtattccatgcttcatcatgttgcgaaatttgatctttccttggaagcggtcgagcgtgaagaggacatcggcctaagctttgactatgcgactgccttgtttgaggacgagacgatccgccgctggagccgccactttgtcaatatcatcaaagcggccgcggctaatccgaacgttcggctgtctgatgtagatctgctttcatctgcagaaacggctgttttgctagaagaaagacatatgactcaaattaccgaagcaacctttgcagcactttttgaaaaacaggcccagcaaacacctgaccatcctgcggtgaaggctggcggaaatctgctgacctatcgcgagcttgatgaacaggcgaaccagctggcgcatcatcttcgtgcccaaggggcaggaaatgaagacatcgtcgcgattgttatggaccggtcagctgaagtcatggtatccattctcggtgtcatgaaggcgggggcagctttccttccgattgatcctgatacacctgaagaacgaatccgttattcattagaggacagcggagcaaaatttgcggtcgtgaatgaaagaaacatgacggctattgggcaatatgaagggacaatcgtcagccttgatgacggtaaatggagaaatgaaagcaaggagcgcccatcatccatttcagggtctcgcaatcttgcatacgtcatttatacgtccggtacgaccggaaagccgaagggcgtgcagattgagcatcgcaatctgacaaactatgtctcttggtttagtgaagaggcgagcctgacggaaaatgataagactgtattgctttcatcttacgcatttgaccttggctatacgagcatgttccccgtacttctgggcgggggcgagctccatatcgtccagaaggaaacctatacggcgccggatgaaatagcgcactatatcaaggagcatgggatcacttatatcaaactgacaccgtctctgttccatacaatagtgaacaccgccagttttgcaaaagatgcaaactttgaatccttgcgcttgatcgtcttgggaggagaaaaaatcatcccgactgatgttctcgccttccgtaagatgtatggacataccgaatttatcaatcactacggcccgacagaagcaacgatcggcgccatcgccgggcgggttgatctgtctgagccggatgcatttgcgaaacgcccgacaatcggacggccgattgcgaatgccggcgcgcttgtcttaaatgaagcattgaagcttgtgccgccgggagcgagcggacagctctatatcacgggacaggggcttgcgagagggtatctcaacaggcctcagctgacagccgagagatttgtagaaaatccatattcgccggaagcctcatgtacaaaaccggagatgtcgtacgaagactttctgacggtacgcttgcatttatcggccgggctgatgatcaggtgaaaatccgaggctaccgcattgagccgaaagaaattgaaacggtcatgctcagcctcagcggaattcaagaagcggttgtactagcggtttccgagggcggtcttcaagagctttgcgcgtattatacgtcggatcaagctattgaaaaagcagagctccggaagcagctttccctaacactgccgtctcatatgattcctgctttctttgtgcaggttgacgcgattccgctgacggcaaacggaaaaaccgacagaaacgctttgccaaagccgaacgcggcacaatccggtggcaaagccttggccgcaccggagacagcgcttgaagaaagcttatgccgcatttggcagaaaacgcttggcatagaagccatcggcattgacgacaattttttcgatttaggcggccattcattaaaagggatgatgctgattgccaacattcaggcggaattggagaaaagcgtaccgcttaaagcactgttcgagcagccgactgttcgccagctggcggcttatatggaggcgtctgctgtttcaggcggccatcaagtcctcaaaccggctgacaagcaggatatgtatccattgtcatccgcacagaaacggatgtacgtgctcaatcagcttgaccgccagacgataagctacaacatgccatctgttcttctaatggaaggagagcttgatatttcgtgcctgcgcgattcactcaatcagcttgtgaaccgtcacgaatcattgcggacgtcatttatggaagctaatggtgagcctgttcagcgcatcattgagaaggcggaggttgatcttcatgtgtttgaagccaaagaagacgaagcggaccaaaagattaaggaatttatccggccattcgacttaaacgacgcaccgctcattcgcgcagctttgcttcgaatagaagcgaaaaaacatttgctgcttttagatatgcatcatatcatcgcagacggcgtctcaagaggcatttttgtaaaagaattggcgctgctttacaaaggagagcagcttccgcagccggcgcttcattataaagatttcgccgtttggcaaaatgaagctgagcaaaaagaacggatgaaggagcatgaggcgtactggatgtcagttctttcaggcgagctgccagagcttgatctcccgctcgattacgcccgtccacctgtgcaaagctttagaggagatacgatccgtttccgtacggaaagtgagacggcaaaggcggtagaaaaactgcttgcggaaaccggaacgaccttgcacatggtgctccatgctgttttccacgtctttttaagcaaaatttccggacagcgggatatcgtcatcggctccgttactgccggcaggacgaatgctgatgttcaggacatgccgggaatgttcgtcaatacacttgccctgagaatgaaagcgaaagaacagcaaacatttgcggagcttttggagcaagcaaagcagacgaacctgtcagcgcttgagcatcaggagtatccgtttgaagatctggttaatcagcttgatctccctcgggatatgagccgaaacccattgtttaatgtgatggtgacgacagaaaaccctgataaagaacagcttacattgcaaaatctgagcatttcaccttatgaggctcatcagggaacttctaagtttgatctgacactgggcggatttactgatgaaaatggcattggcttgcagctcgaatatgcgacggatctgttcgcaaaagaaacagctgaaaaatggagcgaatacgttctgcggctactaaaggctgttgcggataacccgaaccagccgctttccagcctgtcactggtcaccgagacagaaaagcaagcgcttcttgaggcatggaagggcaaggcgctgcctgtgccgacagacaaaacagttcatcagctattcgaagagactgtccagcgccacaaagaccgcccggctgtcacatacaacggccaatcttggacgtacggcgagctgaatgcgaaggcaaaccgtctcgcgcggattctgatggactgcggcatcagcccggatgaccgcgtcggcattctcacgaagccgtcgcttgaaatgtccgccgcggtgctcggcgtcttgaaagccggagcggcgtttgtgccgattgatcctgactacccggatcagcggattgagtatattttacaggacagcggcgcgaagctcctcttgaaacaggaaggcatttcagtgccggacagctatacgggagatgtcattcttctcgacggaagccgcacgattctaagcctgccgcttgatgaaaacgacgagggaaatccagagacggctgtaaccgcggagaacttggcgtacatgatttacacgtctggaacgaccggacagccgaagggtgtcatggtcgagcaccatgcgcttgtgaacctgtgcttctggcaccacgacgcgttcagcatgacagcggaggaccgcagtgcgaagtacgcgggcttcgggttcgacgcttccatttgggagatgttcccgacctggacgatcggtgctgaacttcacgtcattgatgaagcgatccgcctcgatatcgtccgcctgaacgattattttgaaacgaacggcgtaacgatcacgttcctgccgacacagcttgcggaacagttcatggagcttgagaacacatcacttcgcgtcctcttgaccggaggagacaagctgaagcgcgcagtgaaaaagccgtacacactcgtcaacaactacgggccgacagaaaatacggtcgttgccacaagcgcagaaatccatccggaggaaggctcgctttccatcggaagggccattgccaatacgagagtatacattctcggcgagggcaatcaggtgcagccggaaggcgtagccggagagctttgcgtggcggggcgcggactggcacgcggctatctgaatcgagaaggcgaaaccgcgaagcggtttgtcgctgatccgtttgtgccgggtgagcgcatgtaccgcaccggcgatttggtgaaatggacgggcggcggcatcgaatacatcggccggatcgaccagcaggtcaaggtccgcggctaccggatcgagctttcagaaattgaagtccagctcgcccagctttctgaggtgcaggatgcggcggtgacagctgtcaaggataaaggcggcaatacagcaatcgcggcgtatgtcacaccggaaacagctgacatagaagcactaaaatcagcactaaaggaaaccctgccggattacatgatcccggcgttctgggtgacgctgaacgagcttccggttacggcaaacggcaaagtggaccgcaaagccttgcctgacccggacatcgaagcgggaagcggagaatacaaagcgccgacgaccgacatggaagagctgcttgccggcatctggcaggacgtgcttggaatgtctgaagtcggtgtcaccgacaatttcttctcgcttggcggagattccatcaaaggaattcaaatggcgagccgcttgaaccagcacggctggaagctggaaatgaaagatctcttccagcatccgacgatcgaggagcttacccaatatgtagagcgtgccgaaggcaaacaggcagaccaaggcccggtagagggcgaagtcatcctgacgccgatccagcgctggttctttgaaaagaacttcacgaacaagcaccactggaaccaatcggtgatgcttcacgccaagaagggctttgatcctgaacgggtggagaaaacattgcaggcgctgatcgagcatcatgacgcgcttcgtatggtttaccgtgaggaaaacggggacatcgttcaggcgtatcaaccgatcagtgagagcaaggtcagcttcgaaatcgtggatctgtacggctccgataaagacatgctgaaaagccaggtcaagattctagcggacaggctgcaaagcagtctcgatctgcgaaacgggccgcttttaaaggcggagcaatatcgcacagaagctggggatcacctgctcattgctgtacaccatctcgtggtcgacggtgtgtcatggcggattttgcttgaagactttgcttcaggctacatgcaggctgagaaagaagagagccttgtcttcccgcaaaaaacaaactccttcaaggattgggcggaagaactggcggcattcagccaatcagcgcatcttttacagcaggctgaatactggtcgcaaattgccgctgaacaggtttctcctttaccgaaggattgtgaaactgtgcagcggatcgtcaaggatacatcatccgtcctatgtgaattaacggaagaagacactaagcatcttttaacagatgttcatcagccatatggaactgaaatcaacgatattcttctcagcgcgctcggtttgacaatgaaagaatggacaaagggtgccaaaattggcattaaccttgagggacacggccgggaggacatcatcccgaatgtgaatatctccagaacagtcggctggtttacggcacaataccctgttgtgctcgacatgtctgaagcagatgcctcagctgtgatcaaaacagtcaaagaaaacctgcgccgcattccggacaaaggtgttggctacggcattcttcgttatttcacagaaacagcggaaacaaagggcttcacaccagagatcagcttcaactatttgggccaattcgacagtgaagtcaaaaccgatttctttgaaccgtccgctttcgatatggggcgccaagtaagcggggaatcagaggcgctgtacgctttaagcttcagcggcatgatcagaaatggccggtttgtgctttcctgctcctacaatgaaaaggagtttgaaagagccacgattgaagagcgaatggaacggtttaaagaaaacctcctgatgttaatccgccattgcacggaaaaagaagacaaggaattcacaccaagcgactttagcgccgaagaccttgaaatggacgagatgggagatatctttgacatgcttgaggagaatttaaaataaaacgcaagggaattacagaaggcgggagcgaaacatatgagtcaatttagcaaggatcaggttcaagatatgtattacctatcgccgatgcaggaagggatgctttttcatgccatcctgaatcccggccaaagcttttaccttgaacaaatcacgatgaaagtaaaaggcagcttgaatatcaaatgtcttgaagaaagcatgaatgtgatcatggaccggtacgatgtatttcgtaccgtgttcattcacgaaaaagtaaaaagacctgtccaagtcgtattaaaaaaacggcagttccatatagaagaaatcgatctgacacacttaacgggcagcgagcaaacagccaaaatcaatgagtacaaagaacaggataagatcaggggttttgatttgacgcgggatattccgatgcgggcagccattttcaagaaagctgaagaaagctttgaatgggtgtggagctaccaccacattattttggacggatggtgcttcggcatcgtcgtacaggatctatttaaggtatacaatgctctgcgcgaacaaaagccgtacagccagccccccgtcaaaccgtataaagactacatcaagtggcttgaaaagcaggataaacaagcatcactgcgttactggcgcgagtatttagaggactttgaaggacaaacgacgtttgcggagcaaagaaagaaacaaaaggacggctatgagccgaaagagctgctcttttcactgccggaggcggaaacaaaggcctttaccgagcttgcaaaatcgcagcataccactttaagtacggcgctgcaggcagtctggagcgtattgatcagccgctatcagcagtctggcgatttggccttcggtacagttgtttcagggcgtcccgcggaaatcaaaggcgttgaacatatggtcgggctgtttatcaacgttgtcccgagacgtgtgaagctgtctgagggtatcacatttaacggcttgctcaagcagctgcaggagcaatcgctgcagtctgagccgcatcaatatgtgccgctttatgacatccaaagccaggccgatcagccgaaactgattgaccacatcattgtttttgagaactatccgcttcaggatgcgaaaaatgaagaaagcagtaaaaacggctttgatatggtggatgttcatgtttttgagaagtcgaattatgatctcaacctgatggcttccccgggagatgagatgctgattaagcttgcttataacgagaatgtgtttgatgaggcgtttatcctgcgcttgaaatctcagcttctcacagcaattcagcagcttatccagaatccggatcagcctgtcagcacgatcaacctcgttgacgacagggagagagaatttttgctaaccggcttaaacccgccggctcaagctcatgaaacaaagcctctgacggattggttcaaggaagcagtgaacgtcaatccggatgcacctgcgcttacgtattccggccagaccctgtcttatcgcgaattagatgaggaagcgaaccgccttgcacgccggctgcaaaaacacggtgcgggcaaaggctctgttgtagcgctgtacacgaagcgctcacttgaattggtgatcggcattctcggtgtattaaaggcgggagcagcctatctgccggttgatccgaagctgccagaggaccgaatctcgtatatgctggctgacagtgcggcagcctgtcttctgacgcatcaggagatgaaagaacaagcggctgagctgccgtatgcaggcacaacgctcttcattgatgatcaaacacggtttgaagaacaggcaagcgatcctgcaaccgcgattgatcctaatgatccggcatatatcatgtacacgtccggcacaaccggaaagccaaagggcaatatgaccactcatgccaatattcagggtttggtcaagcatgtagactacatggcattttctgatcaggatacgttcttgtctgtttcgaattacgcctttgacgcatttacctttgatttctatgcttctatgctgaatgcggcacggctcattatcgcagatgaacatacgctgcttgatacagaacggctcacagatctgatcctgcaagagaatgtcaatgtcatgtttgcgacaaccgcactatttaatcttctcacagatgcgggagaggattggatgaaggggcttcgctgcgtgttattcggcggagagcgcgcgtctgtgcctcacgtcagaaaagcgctgcgggtcatggggccgggcaagctgattaactgctacgggccgactgagggaacagtgtttgcgacagctcacgtcgtgcatgatctgccggattccatctcctcattgtcgattggaaagccgatcagcaatgccagtgtttatattctgaacgagcaaagccagctccagccattcggggcgatcggtgaactgtgcatcagcggaatgggcgtgtcaaaagggtatgtaaatcgtgctgacctcacgaaggaaaagtttattaagaacccgttcaagccgggagaaacgctttaccgcacaggggatttagcgcgctggctgccggatggaacgattgaatacgccggccgtattgacgaccaggtcaaaatacgcggacaccggattgagcttgaagaaatcgaaaagcagctgcaggaatacccaggtgtgaaagatgcggtcgttgtggcggaccgccctgagtctggcgatgcatcaatcaatgcctaccttgtgaaccgaacgcagctttcagctgaagacgtgaaggcgcacctgaaaaaacagcttcctgcttacatggtgccgcaaacctttaccttcttggatgagcttcctttaacgacgaacgggaaagtcaataaacggctgctcccaaaacctgatcaggatcagctggcggaagaatggatcggaccgcggaacgagatggaagaaacaatcgcacaaatatggtctgaggttctcggcagaaagcaaattggcattcatgacgatttctttgcgctcggagggcattccttgaaggccatgaccgccgcttcccgcatcaagaaagagctcgggattgatcttccagtaaagcttttgtttgaagcgccgacgatcgccggcatttcagcgtatttgaaaaacgggggccctgatggcttgcaggatgtaacgataatgaatcaggatcaggagcagatcattttcgcattcccgccggtcttgggctatggccttatgtaccaaaatctgtccagccgcttgccgtcatacaagctgtgcgcctttgattttattgaggaggaagaccggcttgaccgctatgcggatttgatccagaagctgcagccggaagggcctttaacattgtttggatattcagcgggatgcagcctggcgtttgaagctgcgaaaaagcttgaggaacaaggccgtattgttcagcggatcatcatggtggattcctataaaaaacaaggtgtcagtgatctggacggacgcacggttgaaagtgatgtcgaagcgttgatgaatgtcaatcgggacaatgaagcgctcaacagcgaagccgtcaaacaaggcctcaagcaaaaaacacatgccttttactcatactacgtcagcctgatcagcacaggccaggtgaaagcagatattgatctgttgacttccggcactgattttgacatgccggaatggcttgcatcatgggaagaagctacaacaggtgcttaccgtgtgaaaagaggcttcggaacacacgcagaaatgctgcagggcgaaacgctagataggaatgccgggattttgctcgaatttcttaatacacaaaccgtatcggtttcataaatgaagtgatgaaaggaggagacagccaatgagccaactcttcaaatcatttgatgcgtcggaaaaaacgcagctcatctgttttccgtttgccggcggctattcggcgtcgtttcgccctctccatgcttttttgcagggggagtgcgagatgctcgctgccgagccgccgggacacggcacgaatcaaacgtcagccattgaggatctcgaagagctgacggatttgtacaagcaagaactgaaccttcgccctgatcggccgtttgtgctgttcggacacagtatgggcggaatgatcaccttcaggctggcgcaaaagcttgagcgtgaaggcgtctttccgcaggcggttatcatttctgcaatccagccgcctcatattcagcggaagaaagtgtcccacctgcctgatgatcagtttctcgatcatattatccaattaggcggaatgcccgcagagcttgttgaaaataaggaggtcatgtcctttttcctgccttctttccgatcagattaccgggctcttgaacaatttgagcttttcgatctggcccagatccagtcgcctgttcatgtctttaacgggcttgatgataaaaaatgcatacgagatgcggaaggctggaagaagtgggcaaaagacatcacattccatcaatttgacggcgggcacatgttcctgctgtcacaaacggaagaagtcgcagaacggatttttgcgatcttgaatcagcatccgatcattcaaccgtgatcaaaagcggacagcttcggctgttccgcttttttttgtgttgaatgccaatttttgcatggtataatagtcgaaatactcaaataaaggaaggtcgaaacatgcgcacgtctcccaggatgaaatggtttgtattgctgtttacgtttgttttcgccatcggaatgaactcattcagaaattcctttcaattttttatgctgccaatggcagatgccttccatgccgacaggtcgctgatttcggtttctgtcagcatttttatgatcacaaccggcatcgtccagttttttgtcggtttttttatcgaccgtttcagtgtcagaaaaattatggcgcttggagctgtctgcatcagcgcaagctttttggtgcttccttattcaccgaatgttcatgtgttttccgccatttacggtgtgcttggcggaatcggctattcctgcgcggtcggcgtgacgacccagtatttcatcagccgttggtttgacacacacaaaggtctggcgcttgctattttgaccaatgccaactctgcgggcctgctgcttctctcgcccatttgggctgcggctccgtatcatgccggctggcagagcacctatacgattttgggaatcgtcatggcggctgttctgctgccgctcctcgtctttgggatgaagcacccgccgcatgcgcaagcggagtctgtgaaaaaatcttatgattggcgggggttttggaacgtgatgaagcaatcccgcctcattcatatcctgtacttcggcgtgtttacttgcggatttacaatgggaattattgatgctcacctcgtcccgatacttaaggatgcgcatgtctctcatgtcaacggaatgatggccgcgttcggggcgtttatcatcattggcggattattggcaggctggctgtctgatctcctcgggagcagaagcgtcatgctatccatcttatttttcattcggctgctcagcctcatttgcctgctcattcccattctcggaattcatcaaagcgacctttggtacttcgggtttatcctgttattcgggctcagttacacaggcgtgatcccgctgaccgcggcgtcaatttcggaaagctatcaaacaggattgatcggatcgctgttaggcatcaatttctttatccatcaggttgccggagctctcagcgtgtatgcgggcggtttgttttttgacatgactcatggttatttgctgattgtcgctgtgtgcatcgtgtttgtgggtttatcggctgtaatagagctggtgccgtttttagataaacaaaaggcaaacgaaacccaccaatcaatataaaaggatcagcactgtcaatgctgatcctttttaaatttgagtttttttgtttcggtatttttaaggataatctccttgaatctgttcatctccacttcggaatgaaaaaaatgttttgggatcgcaatatattggctgctggatgtattgatgcggaagatattcttatattcgaaaacagctgtgatttcattccaattgaaaatgaggtcatattttttagaacatatacgaattccttcttggttcagagtatatgttcttttagatttcatccgttcgttcttcttgtatgctctggaaaacttcacatatagaagaaggaggagcagcagtgtaaacagaactgacatcacgataatcaacatactgttcataaacaagttaagcgcgtcactgccataaacgatacggggccatccattaatgaagttaactgcagcaaatatggcgcaaaacaacagaaagtaaaagcatgatatttttgcgatttgataaaaaaagatttctcttacatccttaaaagcgatttctcctggaagattgatactttcactagcatattgaatcatacggtaaacctacacctctaaccatgtttttcctttcagtctagcataatttctcatttttttgcagacataccagggcgctttgtttttttctccagattgatattgctccccaccacgccaatcataatacaaacagccccggcaagatgataccaggccaggctttcgttgagaatcacaactcctgcaatcatcgtcacaatggtagatacatgattaaaagcgctcattttaaacgcctcaattcgcgacagcgtatagttagacagaaatgaagtgacaagtgaagacagcacgcccaaatacacaatggcgagaacgaagccgggctcccggaacggcagaaaataagtgccgactgttcccgccgctccgtgacgcacaagggcgatggcgttgaagacgacaaagccgatggctgacatgatgtaggtgagctctgtcagcttgaaccgctgcgtcatttttctggcagcagtattgtacatcgctgaagacaaagcggacaataggatcagcaaagacccttttaagctggctgattccacgtcaacgcctttcatcacaaaaataaacatgacgccggcaacggataaaaccgtgaaccccttttgcgtccacgttgggcgttcctttaaaatataagcggcaaagaccatcgtgaaaatcggaatggctgcctgaataattcccgcttcagaggaggacgagtacacaaggccgaatgcctgaaagctgaaaaataacgcgggatacagcagggcgagcggcaaaatggcaatgacgtcctttacgcggattgatagctttacccagccgaataagatcggtacagtggccgcagcaaacgcaatggtgaaccgatgcgccaaaatatcaaacggctctgctgtttgcagtgcgatttttacgaatagaaaggataaaccgataatgaacgaatataaaatagccgctatataagcgggggcttgctgatgtttaaccataatgggaagtgctcctttacctgaattgcagcgccggtcgctccctttattgtatggccgcggtcagaacggtacaatgagaaaaacaatgaactgtaccggtacaaaacagggggagaaggcatggagaaatatatgagtctagtaacgaggatagaggagatgatgcaaagcaccgcctatcaagaaggagacaggcttccatctatccgtcagctgtccgcccgctaccaagtcagcaaaagcacagtgatccgcgcgctgcaggagctggaaaagcgccaccttatctattctgttccgaaaagcggctattatattgtgaaaaagacagggaaatcaaaaagcgggcagcttggccccatcgactttgccacatctgcgccggatccagatgtgtttccgtatcttgattttcagcactgtatcaacaaagcgattgatacatacaaaaacgatttgtttatttatgggacgccaaaggggcttccatcactcatccgcgtactccgaaagctcttggccactcaacaggtatttgcggatgaacggcatattttcattacatcaggtgtccagcaggcgttatccttgctttgtgccatgccgttcccaaatgggaaagagaagatcgccattgaacagccgggctaccatttgatggtcgaacagcttgagacggtcgggattcccgccatcggggtgaaacgaacagaagaagggcttgatatagccaaggttgagcggttatttcaaacagaatcgattaaatttttttatacgatgccgcgcttccataacccgcttgggtgctcattgtcagagcgtgataaacaggagcttgtgagactggcagaagcgtatgatgtctatctcgttgaggatgattacctcggtgatctggaggaaaataaaaaggcagatccgctgtacgcatatgatctgtcctcacatgtcatctatttgaaaagcttctcgaaaatgatgttccccggcctccgcgtgggggcggctgttttgcccgaagcgctgactgacacgttctatgcgtacaaaaaactgaacgacatcgactgttcgatgatttctcaagcggcattggagatttacctgaaaagcggtatgtatggaaggcataaggagaaaatcagagattcttataaagagcggtcgctgaggctacatcaagccattcgaactcacaggcagctgggaagcggacgctttacgttctccagcgggcaggcaccctgtatgcacacccatctggtgcttcctcaggatctgcccgcctcaagagtgattcatagactgaaaaaacaaggggttctccttgaggcgatagaccgtcattatttatcagattatccgaaagaaaatctattaaaaatcaatatttccaatgtgaaaacggaagatattgagcgcggtgtcaagctgttgatgagccatttataaaagctcttcgtacgagaccattgtgatatcctcagggaaatcagggtgtgcggcgcatacagccattttgtagccgggatcgacctcatacgttttgatatagcatggggaatggctgtccggaagctcaatggatacttgtccgtcctggtgcaggcgcactgaaaaggaatcaagcggaagcgataagcctttgccttcctgtttgataaagctttctttcattgaccatagatgataaaaatagtctgtctgctcgtccttgtcttttgctaaaaggtcgctgtactctgtttttgaaaagaagcgcttggcgatctcaaggctgatcggtttcgttttttcgatatctatgccgatcggctgtgaatcaaacgcaccaatgacccagcggccggagtgagaaatgttgaaatgagcgtcgggaagatcagggatgcacggcttcccgtattcctgtgtgctaaagcggatatcggatttgtccaactgatactgcctgcttatgactgagcgaacgagcacatctcccagcagggtgcggtgagcatcttctttatgataaaatctccggcatttctcccgtttttcaggtgatatgaaagacatgaaccgttcattttcttcctgtgaaagcgggcggtccatataaattccgtaaatcttcattctagatcctccgtctgcaaaagattgtcaaaaccatcctatcatacttccacaagactcatatagaggagaaaataaaaaaacaaagccaaggcggctttgttttagtgtacaggcggagatgctttcacagcggctgtccgccttgccacagcataattcagcagctggattgactggggcaatgaaaagcgcaaaataagtccggtgaggatggcggtcaaaatggtgccaaaaccgatcggcccgcccatgccccatgccgcaaacaaaatggttatttccatgccgttccgcacccattgcacattccagccggttttttctgtaatcagcatcatcagtgaatcacgcggccccgcgccaaggcctgctgatacataaacaccgacgccgtaaccgatcagcaccacgcctagagagaagacgatgatcgagcctgtgtaggtcgagggggcaggcagaatgaaattgaaaaaatctataaatacaccaatgagcaccatattcaggagggccccaattttcggccaagctctcgtaaacaatgacgtgaatccgacgatgagcgctccaataatgatggaccactggccgacggtaagcccgaagtgctgaaacaggctgtaatgaaatgcatcccacggactaatgccgagtgcttttccttctatcgtcagggatacaccaaaagccaaaatgatcaaaccggcaaaataaaatgtccagcgcagaacaagttcttgcttcacgtgaggtcccttctttcgtaaaaatcagtcgattgtcattgtagcacatctgacagaagggcggaataggcgaaaggggctcaacaaaaaaacagggccgccgcaggcgccctgtttcagcgtgttggcaaacccttgcattcgttgtcaggcctgtgcttcggtgctcacgaatttaatattcgctgtgctccaatgctcgcccttcctagacttcaaaggttttcaatcacgctgaaaatcacaaaatcctaaaacgaaaatcgttttaggattttgtcaataatctgaaacagggcgctggcgccctgtttttcttattacagcgggttcaaaatccggttcaagaaccgctgtgtccgttcttcttttggtgcagagaaaatttgctccggcggtccttgctccacgataacgccgccgtcgatgaagatgacttcatccgcaacttcctgcgcgaacttgatttcgtgggtcacgacgaccatggtccagccttcattggccaagtccttgataaccttcagcacctctccgacaagctcgggatcaagcgctgaggtcggttcgtcaaacagcatgagctcaggctgaatcgccagtgcgcgggcgatgccgacgcgctgctgctggccgccggaaagctggaacggatataaatccattttgtccttcaatccgactttatcaagaagctgaatcgcttcttttctgacttcctctttgttccgtttttgcacctgaacagggccctccatcacgttttcgagggctgtgcggtgcgggaacaggtgatacgcctgaaacaccattccggattttcggcgaagctttaggatatccgcctgtttcacctttttagagaaatcgatggagaaatcatcaaatgcaagctctccgcgattcgggatctccagagcgttcaggcagcggagcagcgtcgttttccctgaacctgaaggcccaagtatggcgatgacttttcctttttcaatcttcatatctatcttttttaaaatttcattttcaccgaatgatttgtttaatcctttaacggtaagcatactcggaacctccttatttggccacgtagcggtcaagacgccgttcgatgacatgctggacgagtgagagcaggaagcagataatccaataaataaaggctgcttcaatatagatcactaaaatttgatcaagattccgcgcgccgatttcctgggcttttctgaacagctcagcgaccagaatttgagaggcgagggatgtatctttaatcaggctgataaaggtattggataatggcgggatcgacacacgaaacgcctgcggcaaaatgacgcggaacagcgttttttgatgtgtcatgccaattgtgtagccggcttcccattgccctttcggcacggataaaatagatgcccgaatgatttcagatgcataggcgccgacgtttaaagaaaaggcgataactgcgcttggaaatggatctaatgtgacgttaaaggccgggaacagatagaaaatgatgaacaattgaacgagaagaggagtgccgcgtattgcggatacgtatacgctgaacacccatctcaaaggtctcactttcgacattctggcaagcgccgtaatcagcgccaggatcattccgaatataaaggaaagaatcgtaaggggaatcgtatagtagattccccctgaaagtatcggccagaatgactgctgcaccagatcccacgggatcgccgtgccaagcgtcaatgccggcagattatttagaaacatcttcgccgaaccattttttagaaattttagaaagagtcccgtcctctttcatttcttttaatgctttgttgacttgatcaacaacctcgccgcttcctttacggaacgtgaaatatgttgactgaggctcacctgtttcaaacgcgattttcacgtttttattgccagatgtttttaagtagttcaatacggcaagcttatcgttgtatgtcatatcgacacggccttgctggatcatttgaagggcctgcgccatgccttcaacgccttctactttagcgccggcatttgtagctaatttgttgtagttgcttgtcagtgattgagctgacgtttttccttttacatctgcttcagacttaatatcgttgttgtcttttttcgttacgacaacggctcttgatgttgtgtatttatctgagaaatcatattgattttcacgatctgtttttccgacttggttggcaacaacgtcaaaccgtttggaattcaggccggcaaacatactgtcccattgtgtttccttaaagtcgactttaagcccgaggcgttttgcgacttctgtgataacttcgacatcatagccagtcagtttatcagtgtctttgtcgtggtaagtgaacggctcatatgttccttccgttccgactgtgagcacaccttttttcttaattgaagcccaaagatcgccatctttggcattatcttttgactgattgtcatttcctgctccgcaagctgcaagagctgcaatacttacgaccatgaataaagccaataatgcttttttcatcttattccccacttttctggttgattttattgaaataaaaaaatagcttacaaatctaaaggataacttttttttagtatgagtcaagtaattggttttcataaggcaaaatcttttaaaataaatccaaaaattgctgtgccggtttaggcaaataactgtccgttctccacatgacagccggtgtcataatgaagggattattttcgatatgaacggtgtgaacgtgatttctcatatgaacgggaatcattgtgacgggcaaaatagacgcgccgaatccggatgacacgaggctgagcaaagttgcagagtcgtggcattcacaaacaatgcgcggctccaggttcaaacgatgaaattcattcatgacctgattatagacgccttttccgttgacaggccgcagcaggatcagcggaaatgaaggaatgtcctccatcttaatggtgtctccgcacggatatccggcttcatctgaaagcacgagcacacatggaatgtcatcaagctgcttgaattgtactgtgtcacttttgatcagtgttgtcgtgaccgccgcatcgatttgccggctttccagcagttccaacagtgtcgcgggctcattttcccaaatattaaaggtgagatggggggtatctctctttgatctgtgttactttttcaagcatcagagccgcgcaataaatcgttgatcccacggcaagtgtgccggctacttcctccttcagctcctgtacctcaatgactgcatcttcaaacctatgcagaatctcttttgctctttttagaaaaacagctccttcatatgtaagagtcatttgttttttcttgttccggtcaaacagaacaacaccaagttcgtcctccagctgtttgagctgcctgcttaaaggcggctgcgccatgtgaagctttttggctgcggacgtgattttctgttcttgggcaatggtaatgaagtatcgaagctggcgaatgtccaaaagaaagcgcctccttatcataccttttaggtattaaatatagatttaatagatatttttcatatggatatatcaggagtatgattgaaatgaaagcagaattcaagcgtaaaggagggggcaaagtgaaactcgttgtcggaatgacaggggcaacaggggccattttcggggtcaggctgctgcagtggctgaaggccgccggagtggaaacccatctcgttgtgtctccttgggcaaacgtcacgatcaaacatgaaacaggctataccttacaagaagtagaacaactggccacatacacttactcacataaggatcaggcggcagccatttcaagcgggtcgtttgataccgatggaatgattgttgcgccgtgcagcatgaaatctctcgcaagcattcgcaccggaatggcggataatctgctgacacgtgcggcggatgtcatgctcaaggagagaaaaaaactcgtcctcttaacgagagaaacgcctttgaaccagattcatctcgaaaatatgctagcgcttacgaaaatgggtacaatcattcttcctccgatgccggcattttataatcagccgagcagcttagaggaaatggttgaccatattgtttttagaacgttggaccaattcggcattcggcttcctgaagcgaagcgctggaatgggattgaaaaacaaaaaggaggagcttgatcatggcttatcaagatttcagagaatttcttgctgcccttgaaaaagaaggacagctgcttacagtgaatgaagaggtaaagccggaaccggatttaggggccgccgcacgggcagccagcaatcttggcgataaaagccctgcgctcttatttaacaacatttacggctatcataacgcgcgaattgcgatgaatgtcatcggctcttggccaaaccatgccatgatgctgggtatgccgaaagacacaccggtaaaagaacagttttttgaattcgcaaagcgttatgaccagtttccgatgccggtcaaacgtgaggaaacagcgccatttcatgaaaatgaaatcacagaagatatcaatttgttcgatatactgcctcttttcagaattaaccaaggtgatggaggctactatttagacaaagcgtgtgtcatttcccgtgatcttgaagaccctgacaactttggcaaacaaaatgtcggcatttacagaatgcaggtcaaaggaaaagaccgtctcggcattcagcctgtcccgcagcacgatattgcgatccatctgcgccaagctgaagaacgcggcatcaatcttccggtcactattgcgctcggctgtgagccggtcattacaacggcggcatcgactccgcttctctatgatcaatcagaatacgaaatggcaggtgcgattcaaggcgaaccatatcgcatcgtcaaatcaaagctgtctgatcttgatgttccgtggggcgctgaagtggtgcttgaaggtgagattattgccggagagcgcgaatatgaagggccgttcggtgaattcacaggccattattccggcggacgcagcatgccgattatcaaaatcaaacgcgtatatcatagaaacaatccgatctttgaacatttatacttgggcatgccttggacagaatgcgattacatgatcggcattaacacatgcgtgccgctttatcagcagttaaaagaagcgtatccgaacgaaattgtggcagtgaacgccatgtacacacacggtttaatcgcgattgtatccacaaaaacccgctatggcggatttgcgaaagcggtcggcatgcgcgcactcacaacgccgcacggactcggctactgcaaaatggtcattgtcgttgatgaggatgtcgatccattcaaccttccgcaggtcatgtgggcgctttcgaccaaaatgcatccgaaacacgatgcggtcatcattccggacttatctgtcctgccgcttgatccgggatccaatccatcaggaatcactcacaaaatgattcttgacgccactacaccagttgcgccggaaacaagaggccattattcacagccgcttgattctccgctaacaacgaaagaatgggaacaaaaactaatggacttaatgaataaataaggaaaggatgttcgaaatgcatacatgtcctcgatgcgactcaaaaaagggagaagtcatgagcaaatcgcctgtagaaggcgcatgggaagtttatcagtgccaaacatgcttttttacatggagatcctgtgaaccggaaagcattacgaatcccgaaaaatacaatccagcgtttaaaattgatccaaaggaaacagaaacagcaattgaagttccggcggtgccggaacgaaaggcttgatccgcgtgaactgtatgtcagaccgtctctttgagctgcttgacgggagctgcctgaatgagaagcagcatgaggccttcgttctgcaaacagtatcagaggatggctggccgcatgccgctatgatcagtgcaggtgaaatcatcgcgctgagccgaactgatatccgaatcgctctgtggaaaaacacaatgacttcggccaacatccttcgcacaggaaaagcacagttcacggcgtggtggaagggagcggcctattatgtaaagcttgaatgcgcgcctttaccgcctttgaaagatgccgaatatgaaagagaccgtttttcctgccgcatcgtttcagtgaaggaggacgttgcgaaatacgctgatttgacttcaggtgtccgtatacagcttcacagcgctgaagaggtgctgagcagatgggaaaagaccctggaagatttaaaacggtaatagcgatagcctgacgccatgcgtcaggctttttttatataatgaaaacaaagggggcgtgagaaatggaacgtgcggggatctgtcactcggacggctttgatttagcttatcgaattgagggcgagggcgcacccatccttgtgatcgggagtgcggtttactatccgcgccttttttccccagatatcaaacagaaatatcaatgggtctttatcgaccataggggatttgctaagcctaagcgggagcttcgtgcggaggattcggggcttgatgccgtcttggctgatatcgaaaggatgagagcatttcttcagcttgaggatgttactatcctgggacattccgggcacgcttttatggctttagagtatgccaggacatattccaaacaagttcggaaggtggcgctcttcaatactgcgcctgataacagtgaagaaagacagcgaaaaagcgaatcatttttcatggaaacagccagccttgagagaaagaaacgctttgaaaaagacatcgcgaatttgccgcaggacatcgacaaagatcctgaaaggcgctttgtgcacatgtgtattcgcgctgaagcgaaaagcttttatcaagagcggccgcatgcagctgccttatgggatggtgtattcacgaatatgccgatcattgatgaattatggggcaatacatttgcccagattgatcttattcagcggttagctgatgttcgtataccggtgtatattggattagggagatatgattatttggttgcgcccgtttcgctatgggatgcagttgacggtttatatccccatgtggataaggttatttttgaaaggagcggccatcagccgatgctggaagaaccggaagtctttgatcaaagcttcagcaaatggcttgatcaataaaaaaacagcccgcagatcaaaatccgcgggctgtttctgattataagacccctttcatcgcgcgtttgataaccggcgagagcagcaggagaatgccgccaagaacgatagaaatcaaaccgatggtgccgaagtacattgtttcaggaattttatcaaacaatccggctacttgggcattgatcgcttgggctgctgcgttcgtcagaaaccacatactcattgtctgtgcagagaaggcagctggggccagtttcgttgtcacggataaaccgactggagacaggcacagctctccaagcacgacaagcaggaagctgagaacgagccaaagcgggcttacgagtgcttcttttccttgcatagcagggaataccataatgataaatgacaatccggccaaaataattccgattgagaatttaactggtgtagacggctggcgtttgccaagcttcatccagagccatgcgaatattggtgcaaaaatgacgacaaacaatggatttaatgattggaaccatgatgactgaagttcgaatccgcccaatgaaagtcttattcgttcatcagcgtataccgcaagaatggtcgctccctgttcctgaatggcccagaacatgacagcaccgataaacaaaggaatgtaagcggcaagacgggatttttctgtgctgtccgcttttttgcttgtaaacatgatgatgaaataaatgacaggaatcaaaataccgagaatacttacaaggtcgataaaacgattgatcgtcagcacgcctgtttgtacagagatcatcactgcgatcgccacgatgataacaccgattccggtgccaatcgcagattttttagacagcggattcggcacattggaacctgcaagcccgaggtttttctttcttgtcaaagcaaaaacgataagtccgagaaacattccgaccgcggcagctccgaagccgagatgatagttgtacttctgtccgagtgttccgacaattaacggcgcaagtaaaccaccgaggttaatccccatgtagaaaatactgaaacctgagtcgcggcgcgggtcttctttcgtgtaaagatccccaaccacgcttgaaacgtttggttttaataagcctgttccgacaataataagcaccatgctgatatagaatgcgatcgcgctgcccggataggcgagtgcaatgtggccgaacataatgaatatgccgccgtaaaacacggtgtttgcggtaccgaatacccggtcagcgagccatccgccaataatggtggacatgtatacgagtgatccgtaaatcgacataatggcaaccgcagtgcccttgtcaaagccgagccctccgtttaccgtctctgtatacaaatagtaaagtaagattgctctcattccatagtaagagaaacgttcccaaaattcggtgaaaaatagtgtaaatagtcctcgcgggtgaccaaagaaccctttttgcgggacgcttttaatgatactttcgttatcaatcgaagccatgtcagccaaaccctttctaaaaaaagtgtattataaaaatcatattcttatataatacttgtgtcaatataatttatactcatttcaaatagttccataatggaaaaattataaatacctaaaaatagtgattttctcctaatttttatactctttatcgtgagattttcttacacaactattcctttatatttttttaataaaattttagagaaatgtacaagcagatcgggcctttgtgagtaacatgatagtaatcatagagaaggaggctcgcaattggctgaattcatattaaatgcagcggatttcggtgttcctggagatggtaaaacggattcgacagaacggattaatcagtgcctcagtacagctgtttcgaaaggctatcatactgtctggtttccaaagggaacatatttaatagacgcaacgcttggcggagatcttaatcagaggtttcgaaacgcggggatcattgttcccggcaaccttgagattatgatggaccccgaatgtatcatgaaagtgataccgaatagttcgtggggttattccgcattttatgtaggcaagcaagagaatataaccatttccgggggacaaattatcggcgaacgggatgagcatacgtatgcctcggcagggataaggtcaacccatgaatggggctttggcatatgtattgaaggatgctcgaatgttgtcattgatgatgtgaaaatttccgattttaccggcgatgggatcatagtcagcccaaggggattaaagaccaatcaagattatcgaacgtcagagcaaattatcatccgccgctgtgaggttcggcggtcgaggagaaataacatttccattaccggatgtgacatggtcacggtggaggaatgcttgattgaagatgccggaacggggaatggaacagcgccgaaattcggaattgacattgaaggatatggcgaaggtgatgttgattatgaggaaccgattaatgtatcaattcgcaataaccactttgttggaaacgtttcaagttctgtgaccaattttaacgggtatggcattttaatagaaggaaatcactcagacaatacaatcagctacggatatgggacgcaaacagtgatcaagggaaatatactgaggcgccctgaagacgcggcagctgcgccaagagtcgggataaccggactcggtgtatcacaaggaaaagagaccagtgatgcagtgatcgctggcaacctcattaccggattttcaacaggaattgatgtcaggggaaagagcgttcttgtgacgaacaacaaaatcagcaactttgaaaacacagggatattggtttatcagtcctccgacgtaaaggtagacggaaaccaaattcaaaacggactgtctgaaacaaggcgcagcatcggtcttcgcgcagtgctgtcagatgacaccgcttttctgaataactgtctcattcaagtcgttgacggtgtgagcgtttcgggcggaaacatgatcattaaagataatctcctgagaaaattcagccgaggcatttggattgctcaaggtaacgcggtgattgaagggaatacactgaatcctggcgcgtttgaagcagtgccggaatcatattctgtttccgttacaaacaatgccggcgctatcatcaaaaacaatacatttaaagagtttaaaaattaccccatttactgctccacaagtgcaaaaacctcaattatcggcaaccacttagagagatctccgcttttggtcaccatctatatcagcgccggtgtgcatgagatttttgataataccatttcagtcaacagaacagccgggaatccgattgtgatttatctcaatggctctgcaggctctatcatctcaggaaacaccatcaataacctctccgcgggcactgcgacagctattcaaacaaacacgtcaaccaattccaaaatcatcggcaaccgcatttttaaagggactatcaacaaacacagcagtgatgcaatagacggcaatattatcgtctgaaaaaagcgccccctctaggggttcttttttttcgatttatagatcacgtacatttctctcacaagtactaacacaaaaaataaaagcacgacccattccgcaaatgttgtcatcttaaagctggacatattgttataaatggcttttgttaaactgaacccttgaagcatgtccatcaatacagaaatagctaataaacaaattaatataactcctgtcacgcccaatatcttcatgcttcatcatcctccgcttttagtgtctatcgttggcggagaagttataccgcatctaaacctaatgcataatctcaattttaaaaggaagaatatgagaaaacgacaaggaaaggtatttgtgtatgcctttattttctaagcgaaagaacaatacaagttcgaaagacaagcgcaatacagaagaaaagaatcaggaacagaagcaagaaaaagaaaggccggttctcatttctccaagtttggccaagaatatagcggaaacgaaaaaggaagtcggaagcagctctgacgtcatcattcgcgagattaaaatcggggagcaggatcgtgtccatttggctgttatttatattgcaggcctggtcgataataacacgatccatgagtcgttaatcgatcctttggtacaggatgagtctatccagaattcccatgcgatccagcaaattcttgaaaaaacgctcccgctgggcggagtgaaagcggaaaagagctgggacaagcttttttccgagttaatgctcggcaatgcgctcatttttgccgatggctatgatgaagcgctgatttgcagcactcaagggggagagcagcgctccatccaagagccgagcacccaggtgtcattccgcggcccgcgccaagggtttacagagtctctgcaaaccaatatttccatgatccggcgatacattaaaaatccgaatttatgggttgaaaaaatgaaaaaaggttctgttacgaatacggatatcgctctcatgtacattcaaggaatatgcgatgaaaaggtgctgaaggaagtgaagcagcgcctggaaaaaatagatattgacagtattttggaatctggatatattgagcagctgattgaagatgaaacctttacgacgtttccgactatgtatcatacagaacgccctgatgtagtagcgggtaatctgttagaaggaagattcgcgattattgtggacggaacaccgtttgtgcttattgccccggccttatttgtccagttttttcagtctgttgaggattattattcgcgttttgacattgcgacaagcataagaattcttcgtgttttagtctttttcatttcgcttgtggctccggctgtatacgtggcagccacgacgtttcatcaagaaatgataccgactcagctgttagtggtcattgcggcccagcgggaaattgtcccgtttccggctgttgtggaggcgctgacgatggaggttgcttttgagattctgagggaagcgggattcaggctgccccgggttgttggctcggcagtgtcaatcgtaggcgcgctcgtaatcggccaggctgccgtacaggctggtatcgtctctccggcaatggtgattatcgtggcactcaccgcgattgcgagcttcgcaacaccggcgtttgcaatggcgatttcagcccggcttattcggtttatttttattattgcctcagctgttatgggtttttacgggctgattttagggatcattatgatgtttgtccacttatgcagtcttcgttcattcggcgttccatatatgtcgccgcttgcacccttttcttcacaaggcgtaaaggacgcgcttttccgggttccgtggtgggccgatgaaaaaaggccggaatcggtcagcaaggaagataaggtgcggcaggggcaagatcaacgcccagagccggccgcttcacgaggaatggtgaacaaagatttggaagaaggggatcagaatggtacgtaaatgtctattagccgttctcatgcttttgagcgccattgtgctgcccggctgctgggataagagggagctgacggatcttgcgattatctcggcgattggcatcgatcggacaaacgacagcaactacgtgctgcatcttcaaattatcaatccaggaaatgttgccggcggccttcagggaggcggtgctggagacaggccgcctgtatatgtctattcgattgaaggtaacaatataacggaagcactcagaaaagcctccatgaaggtatcacggcggctttattttgcccataccaatctagtcgtgatcaatgaaaagctggcaaaagaagaaggtttggattttgtattagataatcttgaccgggacacagaattcaggacaacagcaaccttcgtcgttgcccataaaacaaaagcagaaaatattgtgaaaatcctgacgccaattgataaaattccatcaaataaagtcaataaaaccttggatttcacggaggcgcaatacgggcgggtggtcaaaaccaatattcaggacgttttgaaaacacttgccgccaacactatggcaccggtcatccccggatatatgatgattggtgacgataaaaaaggagtcagcatggaaaacacgcaggcgactgacccgaaagccattcttcaggcagatggtctggcggtttttgataaggcaggatatttaaagtattggctggaagatgatgaaagcgtgggggcagtctggcttatgaataagatccagcatacgtttattaatgctgactggggcaagacgaaggatgcggtcagcttgcaggttacccatcaagatacaaagctggtaccgaaaatgcggaacggacgtccgtacatccatgtgaaagtgtcggttgaaggtattattgatgctgtcaaataccctttccaattgtctgatcccaaggtgctggccgctattgaaaaagcgctcaacaaagagcttgaaaaggaaatcagccatactgtgaaaaagattaagaagaataaaatagattttatcggttttggtgacacgatatatagaaagtatccggagcagtgggagaaaatgaaggacacatgggacaaagaatatttgcccgaactgcccatcgatgtgaaggccgagacgtatatcagaaggacgggattgcgaaacgatccgatcaaacaccagtttaaagatgattaggtctgaagaaaggggaagtgacagatggaaaaagccagaataagcataaggcagctgtttgtcatgattatcatttttgaactgggcagctccttattgattacaccgggatcaatggcgggcagggatgcttggatagcagttttattaggctgtgcgatcggactgtttcttttctatttgtatcaaggcatttatcaatgttatccgaattcttctccgaaagaatatatggatgatatgctgggaaccaagctgagctggctgttttcatttctctatatattgtactttgcctatattgccgcaagggtgctgcgtgactttggagaaatgctgctgacgtttgcttatcatgatacacctatcattattgtaaatgctttattaatggtagtaagcatatatgccgtaagaaaaggaattgaagtactcgcacgcgctgccgaacttcttttcggggtcatgtatttactgggcgcgatcgggctcgtgctgattattgtctcaggcactatagacccgcacaatttaaagccggttttggcaaacggtatttctcctatccttcactctgttttcacgcagaccatgtacgtcccatttggtgaagtcgttttatttgtgatgattttccctaacctgaatgacagaaaagatgtgaaaaaaatggggatgattgccatggctattagcggattggttgtggcgctcaccgtggcgattaatatcatcgtgcttgatgttgatcttacactcagatcccagttcccgcttttaagtacgattcagacaatcaaggtcgaagaatttttagaccggctcgatgtcttttttatgctggcgctgatcatcggcggcttctttaaggtcagcctctacttatatgccactgtggttgggacatctacgctctttaaggaaaagaatccctctcaattggcttatccgatgggattgggcatcttaatcctttctttaacgatcgcaactaacttttcagagcacttgaacgaaggcttgaacgtggtgccgctgtatattcatttgccttttcaattattgtttccgctctttctgtttattgtggctgtttggaaaaagaaacgaagagagaagtcaaaagggacaggagcaaaggaatgataaaaagagcggggggatgcagccgccgctctttttatgttcacttctatataaaagggggatatagggtgcgcccctgtctgcactggcagaggcgcgttttgttataccactgcgacgttttccttcacagtaaagcttcctcttgaaagtctgatattgatgtctgacacttttgcaatttgttcatcgtgcgtcaccataatgacgcatttattttccttgtgcgccagatcctgaaagagccgtacgatctcttttgatgtgtcctcatcaaggtttccggtcggttcatcggctacgataagatccgtgtcacagcagaaagcccttgtaattgatacccgctgctgctgtccgccgctcagtgtgagcactttttgccgggcttgtttttcgttgatgccaaccttcagcagcatgtcaagcgcatatgattctttgttcttttctttagatcctgtgatttccatagcggttgtgacgttctgcaaagccgtcatatacgggagcaggttgtacgcctgaaagacgattgatacatattgatttctgaaattggttaagccgattttagaaaccgcttttccgtcgtaaaggatgtttccttcttttggtgcgtcaagtccgcctgccagagacaggaaagtggttttccccgtccctgatgtgccgacgattgtgtagaattttcctttttgaaagctgatgttaatatcctgaaacaatggctggcttttgtctttataccagtagccgacttgctgaaattctaataagctcataggttccgcctctttctattcctgttttgtcaatatcgttttcggatgaagccgcagtactgaaattgacggcagcaatgttgcaatgattgcgattaggatgccgatcccgcccagaataagcatgtcgttcatagaaaccgcgacgttcagtgaatcgataacgtccacgtttgatgaactgtggccgaacattccgccgcccatgccgccaccgccgccgggcatttgtccgcttgcggtttgcgttgaatcggttgatgaactgatttgctgggataaaagctgatttccaagctgatttgcgacgagatttcccgtcacagatgcaaggccgatagcgataacggccacaatcagaatctcagtcaagaactgtccaatcaatttccatcgtttttcaccgatggccattaacacgcccatttcgtatttgcgctccctgattgacatcatgacaatcaggccaagaatgacggcgcctgccactgatacaagatacaccacgtttttagagaaagaagccacattttcaatcggtccgaccatttgctggtaaagctgatcgtttgtattcagtgtgtacgtatcgaagtctattgatgttttcttcgctgcttttacgaaagcatccatatttttcgcgtcgtccatatagtaaacagctgagtcaatcgtatttttatagtcgtcgcctttcagcgccgctgttgctgtgtaaggcgtataaagcttgttataagggtttaagaaagagaaattttgggcttggtcatcgcctgaagatgttgttttataaataccgacgatcttcagctttaccgtcgtatcttcatctgttgctgattcaattgtgatcgaatcgccaacgctcaaatcattttcttccgctaaagtttcgttgatcactgttacttttttgccgacatctgattttgtaatcgcgcgtccgtctgtgatttttgaatctccgtcagagaaatcatcgactaacgctgtgctgatgacaccttcaatcgaaagatcggcttgaaccatttgcggtccgccttgtccgccgccttggctgtttttagcgtttgagcttgaactgctggagctggaatcacttgaactagagctttcaatcgcatcaaagtttcccgcgttggctgaagctgatgtggtgtaattgtagctcttcacatgatcaagcgctgcaagcttattcgcatcagacactttgatcggtgtggattcgaagctgcgtttttcaccgctgtcctgctgtttttccatttgcttttggcggtcaacctgtagtgtcacgcttccgccgagttcctgtctggccagttcgcttgatttttgtgctgccgactggatggtgaggcctgatagaacaaagacacatatgactgtaaacacaaataattgcaataatgtttttccctttttagccttcatattccaaaaggcccgtttgataaagttcatttatgttcctccgtataggtactttgattgataaggccgcctctggggcgggcttgcttgttgataaattaatagtagtccaaaggtatgaaaaaaatatgaacaatctatttctagttgatgaaataaaaactaacaattgtgaaacgcaaaaccttctgtttaaaatggtgctattatataaaaaagcatcaaaacaatcggaggatataatgaaaatattaatgatagaagataatgttagtgtatgtacgatgacggagatgttcttttttaaagaaggttttgaagcggaattcgttcatgacgggttagaagggtaccagcgttttacggaagaaaattgggatctgatcattttggatatcatgcttccatctatggacggcgtgaccatctgcagaaaaataagagagacaagcacggtgccgattatcatgctgactgccaaagacactgaatcagatcaggtcatcggctttgagatgggggcggacgattatgtcacaaagccgttcagcccgctgacattggttgcccgcatcaaagccgtcatcagaagatataaggcgacaggcaaagcggttattgatgaagatatgatcgaaacggaatgctttaccattaataagaagacgagagaagtattattaaacggagagcctgtagaaaatctcacgccgaaggaattcgatctgctttattaccttgtccaaaatccgcggcaggtgttctcaagagaacagctgcttgagcaggtatggggctatcaattttatggagatgagcgaacagttgacgttcatatcaaacggctgcggaaaaagcttgccagcgaagacaagcctttcttgtatactgtgtggggagtagggtataaatttgatgaagattaaatatttatatcagctgctgctaagccacatcagcattttgattttagcgtttgtcattatcatttctctgttttcccactttgtgaaagaatttgcctatcaaaacaaagtagaggaattgacgtcatatgcggtgcagatcgcaaatgaattccaagccggccaggtggacatgcgcaggctctatccttatcaggacatgttaagcacaagaaagacgcagtttatcatctttaatgaagagcaacagccttatttccttcctgaaggctttcatcacccaccaagggaacagctgaagaaatcagaatggaataagctgaaaaaagggcagactgtcatgatcagggcagatggccgttttgatgatgaagtgtcccttgtggcgcagcctatatttgttcagaacgaatttaaaggcgccgttctgctgatttctccgatcagcggtgttgaacagatggtcaatcaggtcaacctctatatgttttacgctgtgatcagcacgcttgtgattacgattcttgtgagctggcttctgtccaaattccatgtcaagcggattcaaaagctgagagaagcgacagataaagtggcttccggcgattatgacatccatttggaaaacagctacagggacgaaatcggcgtactggcgtctgactttaatatcatggcgaaaaaactaaagcagtcaagggatgaaatcaatcgccttgagaagcggagaaggcagtttatcgctgacgtgtcacatgaattaaaaacaccgctgacgacgatcaacggtttggttgaagggctgaacagccatacgattcctgaggataagaaggataaatgcttctcgctgatcagtgaggaaacgaagcgcatgctgcggctcgtaaaagaaaatctggattatgaaaaaatcagatcacagcaaattaccttgaacaagctaaacgttcctctgatcgaggtgtttgaaatcgtgaaagagcacttgcagcagcaggcggaagaaaaacaaaacaagctgatgatccaagtagaggatcacgtcatcgtacatgccgattatgaccggttcattcaaattctcgtcaacattacgaaaaacagcatccaatttacgcaaaacggtgacatttggctgcgcggaatggaaggttataaagagacgattattgaaattgaagacacgggtatcggcattccaaaagaggatattgagcatatttgggagcgattctataaagcagatatttcaagaacgaacacagcatacggtgaatacggactcggtctctcgatcgtcaggcagctcgttgaaatgcaccagggcacagtagaaatccagagtgaagaagggaaaggcacaaagttcatcatccgccttcctttaacggcaaaacagcaatagcatacagggcggcgcatcaactgatgcagccgccttttttgcacaccgcttcggtttattgcgtgctcccgaaaacaaagattgcgtgtttttcgggttgggacgatctataaacatgataaaatatgacataaacagtttttgatgggagagggtgaaggaatgaagagcggggtaattccttcttcagcggtcggtcaaaaaattaacgagtggtacagatatatccggacattcagcgtgccggatgccgaagtgttaaaagctgaaatccagcaggaactgaaacacatgcagcatgattccaacttgctgctttattattcactaatggaattccggcaccagcttatgctggattatcttgagccgttagagaaattaaatatcgaagaccagccaagcctgtctgaattatcaagaaacattgacagcaaccaggcagatctcaaagggctgctcgactattacgtgaatttttttcgcgggatgtatgagtttgataagcgggaatttatttctgccattacatactataaacaggcggagaaaaagctctcctttgtcgcagaccatattgaacgggctgaattctattttaaaatcgcggaagcttattattatatgaagcaaacgtatttttcattgattaatataaaaaacgcttatgaaatttacgtggagcaggaaacctataatgtgagaatcattcaatgccatttcgtcttcggggtcaacctgatggatgaaagaaatttcgaacaagccgcacgccatttcaaattggcgctcaatatggcccaagcggaacaaaaagcccagctggtcggaagagcatactacaatctcggattatgctattacaatcaagaccttctagaccctgccattgattactttgaaaaagcggtctccacgtttgaaagcagcaggatcgtcaattctctcccgcaagcctattttttaatcaccctgatttattataaacagggaaaacatgataaagcttcggaatatcacaagcggggctatgaatatgctaaagaaacagacgatgcagactatgccgtaaaattcgagtttttgcaatccctatatcaggatcagcccaatgaagaaggaatcgaacgatgtttccaatacttaaaaaataaaaatatgtacgctgatatagaggatttagccctagaagtagcaaaatattactatgaacagaaatggtttaaactgtctgcttcctactttctacaagttgaagaggcaagaaaacaaatacaaaggagtgaaggtttgtatgaaattgaaatctaagttgtttgttatttgtttggccgcagccgcgatttttacagcggctggcgtttctgctaatgcggaagcactcgactttcatgtgacagaaagaggaatgacgtaagaacaagccccttctcattagcgagaaggggtttttcttttcaaaaaaacaccgcaggacatagtcttgcggtgccgccttcatggagattacgtttatttagtagcctcctacaaatgcagttcccacaatgatcaagaggataaataacacaacaatcaaagcgaaagaagttccgtaacctgacattttgtgtacctccttgcgagatggcttcagcatatactgcaaaactgtggcggacagggtcccgcagagacggtcagcagcttagtagccgccaacaaacgcagcccctacgataattaaaagaataaacaatacaacgattaaagcgaaagaactgatgccgccgtaaccgccgccgttagagtatcctgacataaggtttcacctccctatgaaggatactataagatatgctgaaccgatccatttggcagggataatagtggacaagagaaaaaatgaagaattcggctatatgaaggtgatataaaaaatagcgggcgctgccgcccgctatttatgtacgattaagagatcagcacgcccgcgaaaaattcctggtataacgcttggacggcttttctttcttcggcttcttttacgccaaacatcatgctcacttcagaagatccctgattgatcatttcgatattcacctgtgcctctgataatgctttggcggctcttgccgttgtaccgacattgtggcgcatcgcttcccctacaaccataatcagggcgagatgatgctcgacgatgacttcatcggcatgcaaatcctcttcgatccgtttgatgacgctgcgttcagtggcggcatccatttgcccctgccgtaaaatgattgtcatgtcatcgattcccgatggaacatgctcatacgtcaaaccatgctcctccaggatgtgaagggctctgcggccaaaaccgatttctctgttcatgagatacttgctgatataaatgctgcaaaaaccggtgtcgctggcaatgccgacgacaggcccgtttgtgttatcccgcttgctgacgacgcgggtgccttcggctgaggggttgttcgtatttttgatctgaacaggaatccccgctctgaatgccggaatgagcgcttcatcatgaaacactgaaaaacccgcgtaggacagctcccgcatctctctatatgtcagctcgctgatttcctttggattctcaacgaaggacggattgacagaatacacagcgtctacgtctgtaaagttttcgtacaaatcggcttgtagtccgttggcaagaatcgaaccggtaatatcagaaccgctccgtgagaatgtgatcacatcgccatccttgctgaatccgaaaaaaccgggaaaaatgatgagtccgtcacgttcccgaagacgatagaggttttgataggattcaggaagaacttgcgcgttgccgggttcatttgtcacaaagaggccagcatccttcgggtttacatattccgctttgacgcctttataacggaagtaagcggcgatcagcttggcattgttatcctctccgctggccttgactgcgtcaaggtattgctcgggattgcttttatctccttctaaaagcgtaaacagatcatttctgattttttcgataatgctttgccccagctgaagctcattggcgatgagagcgtaccgttccacaactgcttccgccagttcaggtgcactgcctgttgccaaatattgttctgcacatgcgattaagagatcagtcactttcgtatcctcggcatagcgttttcccggagctgaaacgactacagctttccgtgccggatctgaggtaacgatgtgaaacaccttgtcaagctgggcgcctgaagcaagtgagctgcctccgaatttaacgaccttcatgtttacatctcctaatgtttaaaattttcacacaaatttagtatttattatctctctttcagtactgtaaatcaagggggaatttctatatggggagaacatttgtattttccacgaggaataatgccaggtttgctgaccgtatacctgcgttataaagataaatatggtaaacagcctaacgttttgggatggaaaatggttagaatgattagtaaaatggataaatgactaggttaatatttttaaagaatattgactaaccctagaaaaatggtaatatgtaaatgataatgataatcaattactatatggccatattgttttgagtccttgcggagtaggagatacgttctttttgctgtaaggatgtaaggaggcagcatgaagctacgttacttatttattctacttatcatattagcagtcacatctgtatttatcggtgtagaagatctgtcgccgcttgatctcttcgatttaagcaaacaagaggcgtcaacgctgtttgcaagccgtttgccgcgattgatcagcattgtcatcgcgggattaagcatgagcatctgcggtttgattatgcagcagatcagcagaaataaattcgtgtcaccgacgacggcgggcacgatggattgggctcggctcggcattttaatttccttgctgctgtttacatcggccagtcctttaatcaaaatgctggtcgcgtttgtctttgcccttgcaggaaattttctgtttatgaaaatccttgaaagaatcaagtttaacgacaccatctttattccgcttgtcggtttaatgctcgggaatatcgtcagttcaatcgcgacatttatcgcatataaatatgacttgatccagaatgtgtcatcatggctgcagggagacttctctttagtcgtgaaaggaagatacgagcttctttatctgagtattccgctcgtcatcattgcctatgtgtatgcggataaattcacattggccggtatgggtgaaagcttttctgtcaacctcggcctgaagtacaaacgggttgtgaacatcgggctcattatcgtgtccctgatcacgtcccttgtcattttgactgtcggtatgctgccgtttctcggtttaatcatcccgaatattgtatcgatttacagaggagacaatctgaagagcagcctgccgcatactgcgctgttgggagcggtgtttgtgctgttttgcgatatactgggcagaatcattatcttcccttatgaaatctcgattggcctgatggtcggaatcatcggcagcggcattttcctgtttatgctgttaaggagaaaagcctatgcgtaaccagatgaaaatagctttgctcgttgttttagccattgtatgtatcggcttgtttctgttttatgacttaggcaattgggattacaccctgccgagacgaatcaaaaaagtcgctgccattgtgctgacggggggagcgattgcgttttcgaccatgatctttcaaacgattacgaacaaccgcatcctgacgccgagcattttgggccttgattctctctacatgctgattcagactggcattatctttttgttcggttctgcgaatatggtcatcatgaataaaaacatcaactttatcatctctgttctgctgatgatactgttttctcttgttttgtatcagatcatgttcaagggtgaggggagaaatatctttttccttctgcttatcggaatcgtgtttggcacgctgttcagcagcctgtcttcctttatgcagatgctgattgatccgaacgagttccaagttgtgcaggacaagatgtttgccagctttaacaatatcaatacggatttgttatggctcgcgttcatcatcttcctgctgacaggcgtttatgtctggcgttttacaaaatttttcgatgtgctgtcgctcggacgcgagcacgccgtgaatttgggcattgactacgacaaagtggtgaagcagatgctgatcgtggttgcgattttggtttctgtttcaacagcgctagtcgggccgattatgtttttaggccttctggttgtcaacctggcgagagaattcctgaaaacatataagcattcatacttaatcgcaggctccgttttcatcagcatcattgcgctggtcggagggcagtttgtggttgagaaagtgtttaccttctcaacgacgctgagtgtcattattaattttgccggcgggatttattttatctacttgctgttaaaggagaataaatcatggtagaggtcagaaatgtaagcaaacaatatggcgggaaagttgttcttgaagagacgtcagtcacgattcaaaagggcaaaatcacctcgtttatcggtcctaacggcgccggcaaaagtacgctgctgtctatcatgagccgcctgatcaaaaaggattccggcgagatttacatagacggacaagagattggagcatgtgacagcaaagagcttgccaagaaaatgagcattttgaagcaggcgaaccaaatcaatatcaggctcacgatcaaagacctcgttagttttggcaggtttccgtactcacagggccggctgacagaggaagactgggttcatatcaatcaggcgcttagctatatgaagctggaagacattcaagacaaatacttggatcagctgagcggcggacagtgccaaagggcatttatcgccatggtcattgcccaggacacagattatatctttctggatgagccgctgaacaatctggatatgaaacactctgttgaaattatgaaactgctgaaacggctggtagaggagcttggaaaaacgatcgtgatcgtcattcacgatatcaattttgcttcagtctattctgaccatatcgtcgctttgaaaaacggccgaatcgttaaagaaggaccgcctgaagaaatgatagaaacgtcagtgcttgaggaaatctacgatatgaccatcccgattcagacgattgataatcaaagaataggtgtctatttttcttaatatatagaagaggtgaagagcatgaaaaagttcgcattactattcatcgctttggtgacggcagttgtgatttctgcatgcggaaaccaaagcacaagcagcaaaggttctgattctaaggaagaacaaatcacggtgaaacaccagctagacaaaaacggaacaaaagtaccgaagagccctaaaaaagttgtcgtatttgactttggaagcttagatacattagataaacttggacttgatgataaagtagcgggactgccaaaacaagccctccctaaatatctgtccaaattcaaggatgacaaatatgctgacgtcggaagcttaaaagagccagacttcgagaaagtggcagatttagaccctgacttgatcattatctcaggaagacaatctgagtcttacaaagaattctctaaaattgcgccgacaatttatcttggcgtagacacagcgaagtatatggaatcatttaagtctgacgcagaaacaatcggtaagatcttcgataaagaagatgaagtgaaggatgaactcgcaaaaatcgatcattcaatcgcagatgtaaagaaaacggctgaaaagcttaacaaaaacggtctcgtcatcatggcgaacgacgggaagatcagcgcattcggtcctaaatcaagatacggcctgatccatgacgtgttcggcgtgacaccggctgataaaaacatcaaagcgtctactcacggacaaagcgtttcttacgagtacatttcaaaaacaaacccggattacctgtttgtcattgaccgcggtacagcgatcggtgaaacatcatctactaaacaagtcgttgaaaatgattatgtgaaaaatgtaaacgcagtgaaaaatgatcatgtcgtctaccttgattctgctacttggtacttatcaggaggcggtcttgagtctatggcacaaatgatcaaagaagtgaaagacggtttagaaaagtaaaacgaaaaagagcctccgctaaatagcggggctctttttttgttaatcagcgtgccggctgctgttcggcagggcgctgaggtttctttaatgtgaatgagagaaggaagccgacaagtgcaatgacggcagccactataaaagcggcgttcatgccgtgcagggcggcatgcttcacatttgtcgtgcctgcatgtgccgcctggttgctcatcacggaaaccaatagtgcggttccgatcgagccgccgacttggcgaatcgtgttgttcatcgcagttccatgcggaatcaagtggcgcggcagcgcgttgattccagctgttgtcaccggcatcatgatcatggcggtgcctaagagacgaacggtgtataaaacgacaatccaagcgagtgacgtatggtcagtcagctgcataaacggcagagatgtcaggaagatgatgcagaaaccggcaatcgccagccctcttccgccgacacggtcaaaaattctgccgataatcggcgacataaagcccatcacaacggctcccggaaggagcataagccctgtatcaaaagctgtgacgtctctgacattttgtgtataaagcggcaggatggtttccgtaccgatcaataatgcaaagacgagggttcccagcagtgttgttaaactgaaaacgccaaacgtgaagacgcggaattccagcatcggtttttcaagcttcatttgtcttgtgataaacaagagcagcgcgatgacacccaccagcagtgaaatcaagacggttgaactggaccagccataagagccgacgcttgagaagccgtacagaaggccgccgaacccaaatgttgaaaggatgactgataaaatatcaatctgtgtttttcttaaagtcgtcacgtttttcatcaggatgctggcaagaatcaaatcaatcacagcaaacggaagaataatataaaacaatgatctccaagagaaagcttcgacagcccatccggaaagagtcggtccgatcgcaggcgcgaatgagatgaccaatccgaccatacccatagcctggccgcgcttttcaatcggaaagattgtcaggaatacagtctgcatgagcggcatcataatgccggctccagccgcttgaatgatacgcgctgtcagcagaaccgggaagttcggcgcgaacgctccgacgactgttccggcagtgaaaatgctcattgctgtgatgagcagcgcccggcttgtgaatttctcaattaaaaacgcggtaatcggaattaaaatcccgttggttaacataaatgatgtggtcagccattgtgcttggttggcatcgacattgaaatccctcatgatatggggaagtgcggtaatcaacaatgtctggttcaaaatcgccacaaacgctccggctaacaaaatgccgacaatgacagaacggttaaaaggtttttgttcaatacttgtgttcaatacatatcccttcttttctctaagtaattaacagtgtttttaacatggaaacgggctgtgttaaaacaccggtttgttccagatagccaatcagtgatttgagtaaaaaagcgcggggttcttccttcttcgcttcttcctccagcatagcggctgcggaagtcagttcatctacgtcatagtccgcggcggacagggaagagatgcctttatgtaattccttcaggctttccgataataggactgatttatcctttggcttgtaggaggatgctgaatgaatataaagctcgatggcttcgggcggaagaagagactggcgggtttccctgtttttgataatctgattgagggtgctgatgataaactctgcgatcgggtcaagctcaagcggtttttcctcgattttgatcagcattaaaaactcacgcatcatgccgtgaagaatgataaccaaatcccacacaaacgggagaatggtttctccatacgcctggatcagcgaatcgcggtgccagcagataatcgtcgatctggtctgatggatatgctgtttgacccggtcattgtgcagcttggggtttccgtaggtcagcatattgaaaaactgctgattccgcctgaagccctccagttccattttgaccttttgcgtcaaacgctcctccggtgtaagtgcggtattttcctgaagtcttgaggccgcggccaccatttgcttctggttaaatgacagcagctccaaaagcagatcttctttagattgaaacagcttatatatcgaagcttttgacatcttacattcttctgcgatcgcctgcatggaaaccgacgtaaaatccttttccgaaaaaagctttcgcgcggctaacaagatatctgtttttttatcaagcatctcatggcttccttctttcttgaacattagaaaacccattggttcacagaaaaccaatgagtaacaatgaaaaaattttaccagataaacaaaatagaagtcaatggattttaaccgggtaaatgaaaggcctgccggaaaatccgacaggccgaataagagcttatttttcaactttaaatccttgtttttcaagcatttcacggatgtgcggatagtacaggcgctcatagtaggaagcgatgctctgtgaccagtttcttgtttcttttccgtttgtccgtttattcatgtattcagacatctgtttgtcgtatgcctgaatgtgagacgtcagctcatcctgattcaaataagtttcctgatgattgacagcttcctgcggcaagcgcggttttttcgctgaacggtcggcaggatgcccaatgacaaggccggataaagggaacacgtattttggaagctcaagcagttcgatcagctcttgagggtttccgcgaactgcaccgatcggaactgtgccaagtccgagtgactcggccgctgctgttgctgtgccgagggcaataccagcgtctactgcgccgacaagaacagattccaatccatttgtgatttccattttgaaatcatgcagatcttcaagcgcaattttggcccggttgaaatctgcgcagaacagcaggaaaacaggagcttgatcaatccatggctggccgcctgccagctcggagattttctttttgcgctctttatcctggactgtgatcacagtcacttgctgtccgttgatagaagaaggggctgattgcaccgcttcaatgatttggtccaattgctcctgagctacaggctcatctgtgtagctgcgaatcgagcggtggtctgttaaagatttaatcacttcattcatatgagacacccttcctttactcgctaagctctgtgcggacaacatcaagaggagcgctcagcagttcttttccttttgcgacaaacccttggaaatgcgcagtttcgttatggaatttcattgccgcttcatctttccatttttcaagcatgacaaatgtattttcttcgcctactttttcgaataggtcgtattgcgcgttgccttcctcagctcttgaatgctgaacaagtgattgagcctcgctcaaaaattcctcgcgtttttctggttttactttgatgtaagcttgtaatacgatcatttaaatctcctccgttgttatgcgaatttattgttcgaatttcatcgaactaaatgtaacatgtattctaaataaggtaaaggaaaaacccttatatagtaaaattgtcattctaattgttgtatgatacatttgtgtcatgaacattccaaaccatccagaaacagaaacattgcagctgacaaaggttcttcatgcacttagtgatccgcttcgtttagagctcgtcaagcaattagctgaagcaaaagaaaaaacgtgcagcacctgtgcagatgtgcaggttgccaaatcgactttgtcgcatcattttaaagttttgagagaatcaggcatcgctcaagttcggatagaaggaaagcgccggtattattcgcttcgcgctgaagaccttgaaaaggcatttccgggcctgcttgaagccgtgctgaatgtagaccaggaccgctggtgaatcaatcccctgtaacggggatttttttatgtccgtaaaccgctttgaaaagcagctgcacaccctcctgaatatcttcttccttcagccgtgcaaagccgataatgagagcgggcctgcccgtttgccgcttgttttccttcaagttaaatcggctcattccgaatatttcaagctgcagaccggcagcatgtgacaggatgtcttgttcggtgcgcctggtatcaaattcggtaacaaaatgcagccccgcatttgctccttttacggtaacctctccgctgaactctgcttctaaagcggtgatcaggcgttctctcttttctttataatgctgcttcattttttttatatgcttctgatattcaccagactcaataaattcctgcagggtgagctgtgtaagtgatgagcaagtctgcagatcgtagccccgctgtttgtatatcctcaacagctcaggcggcaacaccatatagctgatccgcaagccggggagaagggactttgaaaaggttcccatatagataacattttgaaaacggtcgaggctttgcagcgccggaatactgtctacatcatatgtgaattcactatcataatcgtcctcaatgatatatcggcgcggctcctcggctgcccagttcagcagctgaattcttctggatacaggcataatcgttccggacggaaactgatgcgacggggtggtcaccagcacatctggctgctgtctggtgatttcagcaatcgacatgcccttttcatccagcatgatcgtcttgacttgttttccggcattcttcaaaagctgatacatgcgtctgtagccaggctcctccatcgcatacacggcttccttgggtaaaagctcagtcaacagctgcatgagcacctgtgtgcctgcccctatgatcatttgttctggcctgcattttacacccctcgtcagggaaatgagcctggtaatggccgctctcacttcatatatcccttgcggatgtgacatatcgccgagcgtgcggtatgagcgggaggccgctttttgctcgcagcggaaccagcttttgatcggaaaatggtctgtatcggaactcatgtgtgaaaacgatatccaatcactctggtcgatgtgaatctcttttagatcatccggcagtgcaaatggagggtgctcctcggcggaaaacatgtctagttcctccacgaagaaaccctttcgttcaatggcgtacaaatacccttcagccagcagctgctgataggctgaattcactgaatttacgctgaccttgagattttcagccagctcccgcttggagggaaccttcgagtgaggcagcagattgcggctgaggatttcttttttcagcttttgataaatttgctgatagatataatcggcttgctctgaacgatcgagtgtaattgtgatatccattttgtagtttctccttctgataccatcaaaaagttataattggtacttttcatcataccaaagagaagtcagaatgataagaaaataccgacagggggatattcacatgagtcaaacaacagtaagcatcacaactgcacaatggcagcaaaaacgggatcaatttgtgtcaaaaggtgtgagcaacggcaaccgcagtctggcggtcaaaggagaaggggccgagctgtacgatctggacggccggagatttattgattttgcaggcgctatcggcacgttaaatgtcggacactcgcatccgaaggtggttgaggctgtgaagcggcaggcggaggagctgattcatcctggttttaatgtcatgatgtacccgacttatatcgaattagcagaaaaactgtgcggcatcgcgccgggcagccatgagaaaaaagcgatttttcttaactcaggggcggaagcggtcgaaaacgccgtgaaaatcgccagaaagtatacaaagcgtcaaggcgttgtctcatttacgcgcgggtttcatggacgcacgaatatgacgatgagcatgacaagcaaggtaaaaccttataaattcggtttcgggccttttgcgccagaggtttatcaagcgccgttcccttattattatcagaagccggccggcatgaatgatgaaagctatgacgacatgatgatccaagcgttcaatgatttctttatcgcttcagtggcgcctgaaacggtggcgtgtgtcgtgatggagccagtgcagggagaaggcgggtttattattccttcgaaacggttcgtacagcacgtcgcttcattctgcaaagaacacggcattgtttttgttgctgatgaaatccaaaccggctttgccagaactggcacttatttcgcaattgagcactttgatgtagtgcccgatctgatcacggtttctaaatcgcttgcggcaggcctgccattaagcggtgtgattgggcgtgcggaaatgcttgatgcggcagcgccaggggagctgggcggcacgtatgcaggcagcccgctcggctgcgcggcggctttggcagtcttggatattatcgaagaagaaggactgaatgagcgatctgaagaaattggcaaaatcattgaagacaaggcgtatgagtggaaacaagaattcccgttcatcggtgacatccgcagactcggggcgatggccgcaatcgaaatcgtcaaggatcctgacacgcgtgagcctgataaggcaaaagcagcagcgatcgcggcctatgctaatcaaaacggattacttttgctgacagcgggaattaacggtaatatcatccgctttttgacaccgctcgtcatctcagacagcctattaaatgaagggctcagcatcttggaggcgggcctgcgagcttaatcattggaaagaaaacggctgggtctgctatcattttaagtaatcatgaaaagaaaggaatgttcaatatgccagatcaattaacggtctacaacccggctacgggcgaggagatcaaaacgattcctcagcaatcagccaaagaagtagaagaagccattgaacgttcacatcaagcgtttaaaacgtggtctaaaacatcagcgaacgaaagagcgtctcttttgaaaaaatggtatgagctgattgttgaacataaagaagaacttgcagatttaattacaaaggaaaacggaaaaccatacaaggaagcagttggcgaagtgctttacggcgcaggctatatcgaatggttcgcagaggaagcgaagcgtgtgtacggaagaacggtcccggccccgacaacgggtaaacgaattgttgtcacacgccagccggtcggccccgttgctgctatcacgccctggaatttcccgaatgcgatgattacacgcaaagcggcgcctgctcttgccgctggctgtacatttatcatcaagccggcgccggacacaccgctgtctgcttatgaactagcgcgcctcgcatatgaagcgggcattccgaaggatgttcttcaggttgtaatcggcgatggagaagaaatcggaaatgtgttcacaagcagtccgaaaatccgcaaaatcacgttcacaggctcaacacctgtagggaaaatccttatgaaaaacagcgcggacaccgtgaagcacgtctcaatggaactcggcggacacgccccgctgatcgtagatgaagatgcagacattgaccttgctgttgaacaggcgatggcgtccaaataccgaaacgccggccaaacctgcgtatgtgccaaccgcctgatcgttcatgaatccattaaagatgaatttgctgcgaaactgagcgagcaagtgtctaagctgaaagtcggaaatggacttgaggaaggcgtcaatgtcggaccgatcatcaacaaacgaggcttcgaaaaaatcgtcagccaaatagatgatgcggttgaaaaaggcgcgaaagtgattgctgggggcacatatgaccgaaacgatgacaaagggtgctactttgtgaatccgacagtgctcaccgatgtcgatacgtccatgaacatcatgcatgaggaaacattcggcccggtcgccccgatcgtcacgttttctgatattgatgaagcgattcagcttgccaacgatacaccgtatggcttggctgcttacttcttcacagaaaactaccgccgcggcatctatatttccgagaatctagagtatggcattatcggctggaatgacggcggaccgtcagcggttcaagcgccattcggcggaatgaaagaaagcggcattggccgtgaaggcggttcagaaggtatcgagccgtaccttgaaacaaaatatttgtccatcggtttataaagaatgcacgctcctgagagctgccggattttccggcagctctttttgtgttccggcgaataatcacaacaattccagccaaaataacagcaaatacattttgaaagaaggttccccaacaatggatttattattggctcttctcccggctttgttttgggggagcattgttctcttcaatgtgaaattaggcggcgggccgtacagccagacactgggaacgacgatcggggcactcattgtttctatcgttatttacttttttgttcagcccgttctgtcacttcgcatttttattgttggaatcgtatccggcttattttggtcacttggacaggccaaccagctgaaaagcattcaattgatgggcgtgtcgaaaacaatgccgatttccacaggaatgcagctcgtttccacctcgcttttcggtgtgatcgtgttccgcgaatggtcaacaccgattgcgattacgcttggcgttctcgctttgatctttatcattgtgggaatcattctcacgtccttggaagataagaatgataaaaaagagggcgagccaagcaatttgaaaaagggcattttgattctccttgtttcgactcttggttatttggtttatgtagtcgtggctagattattcaatgtgtccggctggtccgcgctgctgccacaggcaattggcatggtggtcgggggttagttttaacctatagacacaaaccctttaacaagtatgcgatcagaaatattctcccagggttaatctgggcaggcggaaatatgtttttgtttatttctcagccgcgagtcggcgttgcaacaagcttttccctttcacaaatgggaattgtcatttctacgctcggcggtattttcatcctgcgtgaaaagaaaacgaaacgccagcttatagcaattgcgatcggaattatcctgattattgccgccgctgtattcttgggaatcgccaaaacaaattcataacaaatggaggaagatgtatatgtatccggatttaaaaggaaaagtcgtcgctattacaggagctgcttcagggctcggaaaggcaatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaagagttcggcacacttgatattatgattaataatgctggtcttgaaaatcctgtgccatctcacgaaatgccgctcaaggattgggataaagtcatcggcacgaacttaacgggtgcctttttaggaagccgtgaagcgattaaatatttcgtagaaaacaatatcaagggaaatgtcattaacatgtccagtgtgcacgaagtgattccttggccgttatttgtccactatgcggcaagtaaaggcgggataaagctgatgacagaaacattagcgttggaatacgcgccgaagggcattcgcgtgaacaatatcgggccaggtgcgatcaatacgccaatcaatgctgaaaaattcgctgaccctaaacagaaagcagatgtagaaagcatgatcccgatgggatatatcggcgaaccggaggagatcgccgcagtggcagcctggcttgcttcgaaggaagccagctacgtcacaggcatcacgttattcgcggacggcggcatgacacaatatccttcattccaggcaggacgcggttaaataaaaaagcgacccagacatgacatctggatcgctttctttattaggcgggctttttcttaacaagcgctgctacagataaaataatggcagccgcagacagcacaatcgctgtaatgtctagagctgaagaacctgggttttcggaatcgtcttttgttttcgtggcgccgtgctcatctgtcacttgttttgcagacgtgatgtttgtaatggaatgaggtgtatcggcatcctcgtcacctgtccactcaacaatgctgccgtctttgtaatattggtatgcgtcccaagcagcttcctccgctttgtcagggtttttggcaacaaaggtaaactgctggaactgtccttcctgaatgcctccgtcagtcgcttcccatgtcacggacactgatttgtcatcatgtttttgagtggaaaccttccagcccggaattggctcatattgctggaattcaacatccttcggcattttgaggacaaccttcgttgtcggcagatttttctcagaaggaaccttcattgtatacgtttcccaagagcctgcagcagactcagccggttttacagaaacatgcgcgctggcaggggccgtaaagaataagagggagccgacaatagccggacatagtgtcaatgcgatttttttcaacaacgtaaacactccttaattggtctttgtaaacatgatattgatttcgttaaagtcgccggtcaggccgtggactttgatcttccagtttcctttttcattaatcgacaggttttgatcttggaagacgccttttgttttttcttttaatgtaaaggtgcttttgttttcgctgcctgacaggcctgttttataaacggttaacgtcatttgctggatgtttttcacgggatctccgttatggtcggtgacacgcagctcaaaaacattttttccgggctggtttgggctgatgctgagagaaacgctttgtccgttctcaatcgctttggtttggtagaacggttccggcgctggctcaggcgggcttggcaggcttgtaaacacggccgctgtgatcaatacagcgatgccgattgcccactccgctttcaacgttcggctgatttctgtgcggcgctgctttctggtaagcagaaaatgaatcgcacctaagaccagcatgaaaacaaacagcccgcttttcactaaaagagcttggccgtacgctgtatggaacagtgaatccattgaacgaatgatgaaaaatccattgagcaagcctgaaaacaaaatgacgccgactgcagtgagcgcccagggagagaaccgtctgatcgtctcccacgcgagcgttttgtcaggctgcctccattcttttgagagcagcaaaacgagtgccgctattccgccgacccagatggaagcggaagttaaatgaaggaaatccatcaaaatgccgaccgttttttcttcaacgacagcagcatgcccggtaaacgccttggcaagcaggagaccgaaaaagaaaatgagcggcgctgtccaatagccaaaggatgaaaagcggtttttccgtatcgcagggatgacagacagtgcgagcagtacgaacagcgcggcctgtatgatccaaatggagccgcctgctgtctcaaacagtgtttctctgatgtagcccggctggaatgcgctgccccagccgccgcctgcgttcgcttttgtctgaatcggaagctgaagcaaaagcgccagccccagtgctgcgatcgagccggtcaggatacgtctcgtccgtttgacgagctgttctgatttccctttataccagaaaagatggaagaaaaccgttccgataaacagagatagggctgtatacagaatcgcgcgatctgttgctgttcccggattcagcgctgaatcggctgctttttggctgctgaatccgccatccgctttcccgatactgaacgggatgacgccggaaaccggatgcccgtccgcggatacggcattccattccgctctgtacacatctttaggcagattcttcttcagcttcactgtcatgatgtgatgattatcttttttgatttcagtcttgtccgtatccacacggtcgccgtttgaattatagactttaatgtaatgaaacccttcttcaaccggttcattaaattcgatttccacctgtgcaggggcgctttttaattcgctgttttccccaggtgaagatttgacaatataggcgtgagcaaagcttgttttcggcaggaaaacaagaaaaagcagaaggatgatccaccatctgtttcgcttcatcactcagacaccaccttccgctgtatgtgttgtgttatttcttggtgcaggtgcagcgtttctttcggtcttgaagcatgtcttccagtgcttggtcgaaagtgcggacggctccgccgaatcctttttgaaatcgttcggcatggtcaagtgtcgcaaacggaatggcctgcggctggcagcagtgcaggtttaattcagcatttacgacgaaataagccgaaccggcactgacggttgtctgtaacagaaaatctctgcaaatcaagtgtgaaacttcttccgttttatccgcgtaacgcaaaaacgcgcaatgtgcgcagcatagctgttcaatgtcttggtttaccgtaatcagctgaaccgaatgagcttgattgacgggcttcaagcaatagctgcacatatgatctgtttgaggtgttcggacggggagcgtgataccgccggcagtttttatgacctgatttgactgaaccagctgattgacatctctatataccgtcatttccgaaacgccgaaccttgcgctgatgtcagaaattctaagcgagccttcttctttcagccacttcagtatgtgttgctgtctattaatcggaagcattcatacaccctcttcattaagatctatttaagcgtagaggattttagagacggagacaagtaagtggatgataaaaaatgtgaaaatgtgttgaacagcaacaaaacgaaacagaagggactctggtataatagacagatggaatagaaagtgaggaataccctatgaaagaaacaccatgcccgaactgcggcaaacctttgacaggcgatatggtcagatcatcaaatgtgccttgtcaatttcgctgcggccactgccgggaacggctttatgaatataaagtttcagctccgattatgctggtatcattagcggccatcgtgctgcttatttatcttttgctgctcctccgcaatgcggcaggctcagtgctgccagctgtacagcacgtgccgatggctgtatttgcgcttgtgtgcgcgtatcccgtttttattgtgagtgagcggatgattgcaaagtacgtgattcaaaatggcaacatcatttatagaggaaagagaaaaggctcctgaaaccaggagcctttttatttttaaaaaattgtcacagtcatgtgccaaagtcctctttactttcaattgtatagggactgtaagcgttttaacatagagtcaaagggaagcatcattctctgaacatatttttgtatcttacagcgacaaacaaaacagggagggtttatatatgcagcagcaagaacagcagcaaggcggcatgaaagtgaaagtgcagcgctttgggagttatttgagcggaatgatcatgccgaatatcggcgcgtttatcgcgtggggtatcattaccgcgctgtttattccggcaggatggtttccgaatgaacagctgaacacgctggtcagcccgatgattacgtatttattgccgcttttgatagcgtatacaggcggaaaaatgatctacgaccaccgcggcggagttgtcggagcgacagcggcaattggggtgattgtcggatcggatattccaatgtttttaggcgcaatgattatgggtccgcttggcggatacctcattaaacagactgataaattattcaaggataaagtcaagcaaggctttgaaatgctgatcaacaactttacggcagggattgtcggcgcggctttaacgattctcgcgttttacgctatcggcccggttgtcttgacgctaaataaattgctggcggctggtgtggaagtcattgtacacgctaatttactgccggtagccagtgtttttgtagaaccggcgaaagtgttgttccttaacaacgccataaaccatggaatcttaagcccgatcggaatcgagcaagcatctcaaacaggaaaatcaattctgtttttagtagaagcaaaccctggaccggggctcggcattttgctggcgtacatgttctttggcaaaggatcttcaaaatcaacggctcccggtgcggcgatcatccatttcttcggagggattcacgagatttacttcccgtacattttgatgaaaccggccctgattcttgcagccattgccggcggagcaagcggactcttaacgtttacgatctttaatgccggacttgtcgcggcagcgtcaccgggaagcattatcgcattgatggcaatgacgccaagaggaggctatttcggcgtattggcgggtgtattggtcgctgcagctgtatcgttcatcgtttcagcagtgatcctgaaatcctcaaaagctagtgaagaagacctggctgccgcaacagaaaaaatgcagtccatgaaggggaagaaaagccaagcagcagctgctttagaggcggaacaagccaaagcagaggaagcgtctgagctgtctcctgaaagcgtgaataaaattatctttgcgtgtgatgcgggaatgggatcaagtgccatgggggcatccatcttaagaaacaaagtgaaaaaagcggagcttgacatcagtgtgaccaacacggccattaacaatctgccaagcgatgcggatattgtcatcacccacaaagatttaacagaccgcgcgaaagcaaagctgccgaacgcgacgcacatatcagtggataacttcttaaacagcccgaaatacgatgagctgattgaaaagctgaaaaagtaatcttatagaaagagagtgatactcatgcaagtactcgcaaaggaaaatattaaactcaatcaaacggtatcatcaaaagaagaggccatcaaattggcaggccagacgctgattgacaacggctacgtgacagaggattacattagcaaaatgtttgaacgtgaagaaacgtcttctacgtttatggggaatttcattgccattccacacggcacagaagaagcgaaaagcgaggtgcttcactctggaatttcaatcatacagattccagagggcgttgagtacggagaaggcaacacggcaaaagtggtattcggcattgcgggtaaaaataatgagcatttagacattttgtctaacatcgccattatctgctcagaagaagaaaacattgaacgcctgatctccgctaaaagcgaagaagatttgatcgccattttcaacgaggtgaactgacatgatcgccttacatttcggtgcggggaatattgggagagggtttatcggcgcgctgcttcaccactccggctatgatgtggtgtttgcggatgtaaacgacacgatggtcagcctcctcaacgaaaaaaaagaatacacagtagaactggcagaagagggacattcatcagaggtcattggcccggtcagcgcgattaacagcggcagtcagcccgaagagctgtaccggctgatgaatgaggcggcgctcatcacaacagctgtcggcccgaatgtgctgaagctgattgctccatctatcgcagaaggtttaagacggagaaacactgcagacacactgaatatcattgcctgcgaaaatatgattggcggcagcagcttcttaaagaaagagatatacagccatttaacggaagcagagcagaaatccgccagtgaaacggtaggttttccgaattctgccgttgaccggatcgtcccgattcagcatcatgaagacccgctgaaagtatcggttgaaccatttttcgaatgggtcattgatgaatcaggctttaaagggaaaacaccagtcataaacggcgcactgtttgttgatgatttaacgccgtacatcgaacggaagctgtttacggtcaataccggacacgcggtgacagcgtatgtcggctatcagcgcggactcaagacggtcaaagaagcaatcgatcatccggaaatccgccgtgtcgttcattcggcgctgcttgaaactggtgactatctcgtcaaatcgtatggctttaagcaaactcaacacgaacaatatatcaaaaaaatcatcggtcgctttgaaaatcctttcatttcggacgatgtgacccgcgtagcgaggtcacctctcagaaaactgggagaaaatgatagacttgtaggcccagcaaagaaaataaaagaaccgaatgcactggctgaaggaattgccgcagcactgcgcttcgatttcaccggtgatcctgaagcggttgaactgcaagcgctgatcgaagaaaaaggatacagcggcgtacttcaagaggtttgcggcattcagtcccatgaaccgttgcacgccatcgttttaaagaaactcaatcaataaccgaccacccgtgacacaatgtcacgggctttttttactatctcgcaatctagtataatagaaagcgcttacgataacagggaaggagaatgacgatgaaacaattcgagattgcggcaataccgggagacggagtaggaaaagaggttgtagcggctgctgagaaagtgcttcatacagcggctgaggtacacgggggtttgtcattctcattcacggcttttccatggagctgtgattattacttggagcacggcaaaatgatgcccgaagatggaatacatacgcttactcaatttgaagcggtttttttgggagccgtcggaaatccgaagctggttcccgatcatatatcgttatggggactgctgctgaaaatccggagggagcttgagctttccattaatatgagacccgccaaacaaatggcgggcatcacgtcgccgcttctgcacccaaatgattttgacttcgtggtgattcgcgagaacagtgaaggtgaatacagtgaagtcggcgggcgcattcacagaggcgatgatgaaatcgccatccagaatgccgtgtttacgagaaaagcgacagaacgtgtcatgcgctttgccttcgaattggcgaaaaaacggcgcagccatgtgacaagcgccacaaagtctaacggcatttatcacgcgatgccgttttgggatgaagtctttcagcagacagccgctgattatagcggaatcgaaacatcatctcagcatattgatgcgctggccgctttttttgtgacgcgtccggaaacgtttgatgtcattgtggcgagcaacttgttcggtgatattttaaccgacatcagctcaagcctgatgggaagcatcggcattgcgccttctgcgaacatcaatccatccggcaaatatccgtccatgtttgaaccggttcacggctcagctcctgacattgccggacagggccttgccaatccgatcggccagatttggacagcgaagctgatgctcgaccacttcggagaggaagagctgggggcgaaaattctggatgtgatggagcaagtgactgccgacggcatcaaaacacgcgacattgggggacaaagcacaacggctgaggtcactgatgaaatctgttcgcgcttaagaaagctctgatgaatcaggccggggcagatggctgcccgggcctgtccatttccttacgaaaatttccacgaaagtctaaccaagcagatccaaatgctgtataataatttggaattcttaggaaagcatcgggtgaaggaagttgaatgcaaaaacaatcacgttaaagaaaaaaagaaaaatcacaacgatcgttatactcagtatcattatgatcgcagctctcatttttacgatcagattggtgttttacaagccttttcttattgaaggatcatcaatggccccaacgcttaaagactcagaaagaatactggttgataaagcagtcaaatggactggcgggtttcacagaggcgacatcatagtcattcatgacaaaaagagcggccgttcatttgtcaaacgtttaatcggtttgcctggtgacagcattaaaatgaaaaatgatcagctatacataaatgataaaaaggtggaagaaccatacttaaaggaatataaacaggaggtcaaagagtcgggtgtaaccttaacgggtgacttcgaggttgaggttcctaccggtaaatattttgtgatgggagataaccgtctcaattcactggatagcagaaacggaatgggcatgccttctgaggacgatatcatcggtactgaatctctcgtcttttatccattcggtgagatgagacaggcaaaataaaactcagtgcaacaaagaacatggaacgtacggaaccaaaacacgcgataataaagcgctgtaagcgattaaaaaatttctgatgaaacagggcggagccttttttccgccccgttttttatgatagagagcgttttgaagaaaagggccctgttgaaataaacagaatcaggattggcgaagccgtgaagcgcatcgaattgataaatctcaagatgggtatgctgtttttcccgcagttttttgataagaagcgctacgtcaaacgacggctcataattagggaaaaacaataggaccgggcaggctggcacgtgatgaagagagtcgcgtatccgggaaccgtaataacaaaccgatccgctcacctcaggcatactgctgcatttccatgcgatagtagcccccacgctgaatccaatcacaaagatgtgccgtccggcgttttgtctgatcacattctggatgatggtttctcccgttttcagccgttcgtgttttgtaaattgttcgtatgccgttttttcttcttgcagtgtgtagacttcatcctcgccgagcaggttgggcgtcaacacatcatatccagccattttgatcagccggcccatctttttcatatggctgtttacaccgtatatttcgtgtgcgagaatgacaagcggttttggggacataacggcctccttttgtgttttttccattatatcctatcgtttcactttaggctgagatataatggtcaaaaaaaggagatataaaatgaactcattatctttgcctcaccgctatccatttttgtttattgatggcgtgacggatagcgagcccggcaaacatgcggcagcttataagctgattagtgagaacgattggtttattactgatacgcaaacagaaatgccgtttttacttgtgattgaagcacttgcgcaaaccgcggcttttacaggaattacagatgagaacagcttgggattattgtcttcggtgaagaaagcggaaaagctgggagaagctgtgcctggtgaccggcttgatcttacgtttgaagtcacgcgcaatcggcgcgggtttgtgttcggacatgccaaggcatcagttggagagcagcctgttgctgaagctgaaatcggcatctatattgaaaaatgaaaaaaacccttcacaacattttgtgaggggttctattttgtgtcgtaatcccgttcgctttgagagttatctctttgctggcgtttgtgtttttcatcattcatattttccttcagctcttcattaggaatcggatcggttaagtcgttgtgctcggggttttcatttggtttgttttgctgttttttttctgtcatgtttgatcacctcaccgtttgttttcctcttatccattctcctcaaacataggaaatcgcttttttgtcccgctgggtataatgtattagaatagagagaagcacaacaaaaagataaagagaggtacatatatgtctgttcaaagagaagatgtagatatcaagctgatcgcaattgatatggatggtacactgctgaacgacgagcagctgatctcggatgaaaaccgcaaagccattcgtgaagcggaggataaaggtgtgtatgtggtgatcagcacgggccggacgctgatgacgtgccgggagctggcggaatcgctaaagctgtcatcctttctaatcacggcaaacggcagtgaaatttgggattcgaattttaatttggtggaacggaagctgcttcatacggatcatattcaaatgatgtgggatttgcggaataagcacaacactaatttctgggcttctacggtgaataaagtatggagaggcgagtttccggaaaacattacggatcatgaatggctcaaattcggctttgacattgaggatgacgatatccgaaacgaagtgcttgaggagctgagaaaaaacaaagagctcgaaatcacaaattcaagtccgacaaacattgaagtcaacgcgctcggcatcaacaaagctgcagcccttgccaaggttacggaaaaactcggctttacaatggagaatgtgatggcgatgggcgacagccttaatgacattgcgatgatcaaagaagcgggtcttggcgtcgcaatgggcaatgcgcaagacatcgtaaaagaaacggctgattatatcacggatacaaatattgaggatggtgtcgctaaagcgattcgccattgggtactataaaaaagagagtcctaagatggactctcttttttagtttggcaggttttcttctgggaccatggtaggttttctgacaaaagtatttcacaaactgatatgattcacttataatgaaataaagttcaaaaattcggaatagtcattccgaatttcgggacaataaatgacataaagcatatcgtttgctttggcaggagggattctgtgtttcagattgatttaaactgtgatttaggagaaagcttcggagcctacaagataggtcttgaccaagatattttagagtatgtgacatcagcgaatatcgcatgcggatttcatgcaggagatcctagtgttatgcgaaaaaccgtcgcgcttgcagcggaaaaaggcgtaaaaatcggtgcgcatccgggtttgccggatttactcggttttgggcgccgcaatatggcgatttctcctgaggaagcgtatgatcttgtcgtttatcaaattggcgcgctctctggctttttaaaagcagagggacttcacatgcagcacgtcaagccgcatggcgctttatacaatatggcggcagtcgatcaaaaactgtcggatgctatcgcgaaagctgtctataagattgatccaggcctgattcttttcggtcttgctgagagtgagcttgtaaaagcgggagaacggatcggacttcagaccgcaaatgaagtgttcgccgacagaacataccaatcggacggcacgctgacaccgcgctcccagccggacgcactcattgaaagtgatgatgccgccgtcacccaggtcatcaaaatggtgaaagaaggggcggtcaaatctcagcaaggacatgatgtgtcattgaaagcagatacagtctgcattcatggagatggagcccatgcgctgacatttgcgcaaaaaatcagaaaacagctcaaagcggctgaaattgaagtgacagctatttcagaacagaggtcaacataaaggaggaacaatagatggagcagcagaaaaagacagcaggaaaaaaagcgggcagctggtcattgttgatgggcgccgcctttttaatggcgacatcagcaatcggaccgggtttcctcacccaaaccgcaacattcacaaacacactcgcagcaagcttcggttttgtcatcttaatttctattattttagatattttcgcccaaaccaatgtgtggcgcatcatcgcagtttctggaaaacgaggtcaggaaattgcgaatatggtgcttcccggactggggtatttcatcgccattctcgtcgtgcttggcggactagcttttaatattgggaatatcggaggggccgggctgggacttcaggtgctgttcggcattacacctgaaacaggcgctttaatcagtgccgttatcgccattttgatttttgtcatcaaggaagcaggaaaagcgatggaccgttttacgcaaatcgcggggttcgtgatgattattttaacggtctacgttgcggcgacgacagctcctccggtcggacaggcagtcgcaaatacattcgtcccggaacacatcagcatatttgccattgtcaccctagtgggcggaaccgtcggcggttatatcacatttgccggaggacaccgtttgcttgatgccggaattaaagggaaggaatccattccgcaggtgacaaaaagctcggttgtcggcattttaattacatctgtcatgcgtatcgctctttttcttgcggttctaggcgttgtatcgaaaggcctgcacattgatgaaagcaacccggcggcctctgtcttcaaactggctgcaggaaatgtcggttataaaattttcggattgatcatgtggtctgcggcgattacgtctgttataggagcagcctatacatctgtttcgtttttcaaaaccttttctccaaaaattgaaaagaattcacgcggtattattatcggatttattgtgatttctacgttagcttttatcacaatcggccagcctgcgaagatcctcgtccttgtcggttcactgaacggcttaattctgccgattgcgctcggaacgctgcttgttgccgcctacaagaaaaacattgtcggtgattataagcatccgctttggctgacaagcacaggcgcgcttgtagtgattgtaatggcagttatgggaatctacacgttaattacacaacttcctcaattgtggagctgatataagtggagcaattaaacaaaatggcgccaaaggatgtacgcgccctgatacgagaggggaaaataaacgggccgaccgcaggcatgtccggcggctacgcccaagcgaatcttgtggttttgaaaaaggaccttgcgtttgactttctgctgttttgccagcgaaatcaaaagccctgccccgtgctggatgtgactgaagcaggttcgcctgtgccgtctctggctgcgcctgatgctgatatcagaacggactttccgaaataccgtatttacaggcacggtatcttaacggaagaagtatctgatattacgccatactgggaggacgattttgtcggctttctgatcggatgcagtttctcctttgaacaggcactgatcaataatgggatagctgtccggcatattgatgaggggacaaacgtctcgatgtataaaacgaatatcgattgtgttccggcgggggcgtttcacggacagatggttgtcagcatgaggccggttcctgaacggctggctgtacgtgccgcacaagtgacctcgcgttttccggctgtgcacggagggccgatgcatatcggtaatccgggagcaatcgggattcgcgatctcgggaaaccggatttcggagatgccgttcccattcgtgacggcgaggttcctgttttttgggcatgcggggtgaccccgcaagccgtggctatgaatgtaaagcctgaaatggtcatcacacatgcgccggggcatatgctcatcacagatattcgagacgagtcgcttgcggtgctgtaacctctcgtcatcctgatgaacgagaaataaaagaggtgagaaagatgactgtacgatatcaaatcgaacagctcggtgattctgcaatgatgatccgattcggagaagaaatcaatgaacaggttaacggcattgtccatgccgcggccgcttatatagaagaacagccatttccgggattcattgaatgtatcccggcttttacaagtctaaccgtattttatgatatgtatgaagtgtacaagcatttgcctcaaggcataagctcaccttttgagaaggtcaagcgcgatgtcgaagagcgcctggcagaaatagccgaagactatgaggtcaaccgccgtattgtagaaattcctgtctgctatggcggtgaatttggtccggatttagaagaggtggcgaagatcaatcagctgtcaccggaggaagtaatcgacattcatacaaacggtgaatatgtggtgtatatgcttggcttcgcgcccggttttccttttctaggcgggatgtcaaaacgcattgcagctccgagaaaatcatcgccaagaccgtcgattcccgcaggttcggtcggtattgcgggattgcagacaggcgtttacccgatttcaacgccgggcggctggcagctgatcggcaaaacgccgctggctcttttccggccgcaggaaaacccgccgacattgttgcgggcgggagatactgtgaaattcgttcgcatctcagaaaaagactatcacgcctataaggaggagtccaattgagcatgaaagtattaaagcccggactgctcacaacggttcaggatataggcagaacgggttaccaaaaatacggcgttctggccagcggcgctatggatacggtttcactgcgcattgccaatctgttgataggaaacggcgaaaatgaagcaggtctcgaaataacgatgatggggcccggtccgtcgtttcatttttcaaaacagacactgattgctgtgacaggggcggacttcacgctgcgtattaatgacgaggaagcgcctttatggaagcctgtgctcatcaaggaaaacagcacggtcagcttgggcccctgcaaactcggcagccgtgcttatttggcggcagccggcggcattgaggtgcctgccgtcatggaaagtaaaagcacatacgtcagaggaagcatcggcggacttcatggcagagcgcttcaaaaagaagatgaactgaacattggagagatgtcagctctttcgcaaaccatcctttcccgcttaagttcgcagcttggaaaacagggatttgcagcaccgaagtggtcagtcagccgcggcagatttctgccattgaagaagaatcccgtcattcgggtgctggaaggaaagcaatttgcctttttcacagaagaatcaaaaacgcgtttttatgaagaagcatttcgtgtcacaccgcagtccgaccgtatgggctacaggctcaaaggagaaccactcgaactgaaggccccgcttgagatggtgtcggaagcggtttcattcggaacagttcaggtgccgcctgacggcaacccgattatcctgcttgcagaccggcagacgactggcggctatccgaggatcgcgcatatcatatccgctgatcttccgattgtttcccaaatcatgccgggtgagcacgtccagtttgagcctgtgtcccttcaggaagcagaagcgcttgcgattgaacgggaacagcatataaaagaactgaaaacgagaataaagatggaatggctgacatagcaaaggggatgcatgatgcagaataaaaacaaaaccgtagtcaaatctatggcgctgctcaatttgtttttgcataaaccaagcctaaccttaagtgaactggtgtcgctgacgggaatgccgaagacctctgttcaccggatggtcagctctttggaggaaatggggttcctcagtcgggatgcgtccggcgcttattcgctgggattggtgtttttggaattcggacagcttgtcgctgacagactggatatcagaaaaatagcgaaaccggtgatggaagagctgtgccgggaagtggatgaggccgtgcagttgatcatgagggacggcaatgaggcgatatacgttgagaaaatagaagggacacagactgtgcggctgtatacggcgatcggcaggcgttcccccctatacgcgggagcgtgcgccagaagcattctgtcctttcttccccgtgaagaaatcgaagcatacatcaaacaaaccgagctcatttcgattggctccggaacgattaccgatcccgaaaaactgcttcaggagattgatgcctctgtgcaaaatggctatactgtcagctattcagagctcgaaaactatacggcggcgatcggcgccccgatctttaaccataagcgccaagtggcagccggcattagcattgcaggctttgaagcgagatttacagaagacaggctgccctatttaacagaaaaggtgaaggacgccgctttacagatttcaagaaaaataggatatacataagtagccaatcttttctctgctgcgtacattaacgtatcgacgttcaagagtggaggaaagaacatggtgcttcgatatacagctctgggcgattccttgacgacagggagaggctccgggctgttttcacccggcttcgtccagcgttttggggacatgatggaagctgacttgaaaacaagaacggcaataaacatatttgccagatcaggcctgaatacagaagagattttgggactcctctcatatccctatgtgcaaaaatgcattcgagatgctgatatgataacgatcacagggtgcggaaacgatctcatcgattcggtcttagcctaccaaacctctaaggatgaaacgattttcagccgtgtatccgcccattgccatgaaaattttgaaaagatgattgccaaaatcgccgagattaaaggaaaaaaaccttccccgtacgccatccgagtgttcaacttatacaatccgtttcccgaaattgatatcgccggcaaatggatcacttcgtttaattcacatttagaaacacttgcatcagcaccccatgtcaaaatcgcggatgcctatagcatcttcaaaggcaaggagcgggaatatctgtcctttgacggtgtccatccgaactgcaaaggctatcaagcgatggctgaagccgttcacaagctaggctataaagaactatcagtttcataaaaaacgcgcctcatgacaggcgcgttttttatgtgtgatcgaaatattaaaagaaacttaaaattctctgtcttctgttctacagacaaacaaagtgcgctagaataatggaggacgtaggcaaatatagccataacgttcaatatttcgtatataaggaaggatggtccttttgtttcggatttttaaaatgtcttttgcggttatcattattatactggcgcttattgcttttaactatacggaacacacctctgttatccaatcggtcatgctcgtctttcttggcgcggtcatgtttatgcaggggcttgaagaacgcaaaaaagaaaatgacggctcaggcgcttttaatatttataccgccgtttttgtatggtctgtctcccttatcggttttacacttcatattatataaatctattacacatcctgaaaatgctcgaccgtcgggaacggggtatagaatcgatgaagcaaggctttccactcttgatactctgaagaaccgcgaaagccttccgtatggttctcaagtgtttcccactccacaagaagcagatatttatgcgtttcctccatgcattttgataacgagtgagtgatatagcccttcatgccggaaataatcggcgccgcttgccggaatgcatcctcaaactcttgttcaaggccttctttaatgtgaagcattgctgcctctctgaccatgctatcccttctttctgtcttttcaaatagtctacagcaaacgataggagatttctgcaaaatcggtgaacttttccttcattttcaaaaaaatcttgcacgcaccaattcaattaagagaaaataacaagtggaaggcaggggaaagtcatgttaaaaaagtgtattctactagtatttctatgcgtcggattgattgggttaatcggatgctccaaaacagattcaccagaggatcgcatggaagcattcgtgaaacagtggaacgatcagcaattcgatgacatgtatcaaagcctgactaaagatgtgaaaaaagaaatctccaaaaaagatttcgtcaacaggtataaagccatctatgagcaggccggcgtaaaaaatttgaaagtcactgcgggagaagtagataaggacgatcaagacaacaagacaatgaaacatatcccgtataaagtcagcatgaacacaaatgccggcaaagtcagcttcaagaatactgctgtgctgaaattagaaaaaacagatgacgaggagtcatggaatatagattgggacccatcgtttattttcaagcagctggctgacgacaaaaccgtgcaaattatgagcattgaaccgaaacgaggccaaatttacgataaaaatggaaaaggtttagctgtcaatacagatgttccggaaattggaattgttcccggagagcttggcgataaaaaagagaaagttataaaagaactcgccaaaaaacttgatttgactgaagacgacatcaagaaaaagctggatcaaggctgggtaaaagacgattcgtttgtgccgctcaaaaaggtcaagcctgaccaggagaagttagtttctgaagcgacgtcattacaaggcgtaacaagaacgaatgtcagctcccgctactatccgtatggcgaaaagacagcccatttaacaggctatgtccgcgccattacagcggaagaactgaagaaaaagaaagaaggaacgtacagcgatacgtctaacatcggtatcgccggacttgaaaatgtgtatgaagacaagctaagaggcacaactggctggaaaatctacgtgccgcaaaccggggaagtcatcgctgaaaagaaagcaaaggacggcgaggatcttcacctcacaattgatatcaaaacgcaaacgaagctgtatgatgaactgaaggatgacagcggggcggcagtcgcgctgcagccgaagacaggcgaaacactcgcccttgtcagcgcgccttcctacgatccaaacggatttattttcggctggagcgataaggaatggaaaaagctaaacaaagataaaaacaatccgttttcagcgaaattcaataagacatacgcgccaggttctaccattaaaccgattgcggctgctattggaatcaaaaacggcacccttaaagccgatgagaagaaaacaatcaaaggcaaggagtggcaaaaagattcgagctggggcggctattcagtgacacgtgtgtctgagagacttcaacaagtcgatttggaaaacgcccttattacgtcagacaatatttattttgcccagaatgcgcttgatatgggagcggacaccttcacaaaaggcttaaaaacattcggtttttcagaggacgttccgtacgaattcccgatccagaaatcgtctattgcaaatgacaagcttgattcagacattttgcttgcggatacaggctacggacaagggcaaatgcaaatgtctccgcttcacttggcaactgcttacacgccatttgttgacaatggagaccttgtcaaaccgacgctgatcaaaaaagattcacaaacagctgatgtttggcacaagcaagtggtcaccaaggaaggagcggcagacattacaaaaggtctgaaaggcgttgtggaagatgagcgcggatcagcgtatcagcctgtcgtgaaaggaatcacagtggccgggaaaacaggaacagccgagctgaaaacatcaaaagatgataaagacggcacggaaaatggctggtttgtcggctacgattacaaaaacaaagacctgcttgtcgccatgatgatccaaaatgtgcaggaccgcggcggcagccactatgtcgttgagaaagcgaaaaatcaatttcaatcgaattaaaatgtctttttaaaaggagcgaaaggaaaaaggggatctgaggccgaatgaactagtaaggggcaaaacccggtttatacaaagaaaagagggattttgcatgcagcgtattcaattggcggaggatcttcaattttcaagagtcatacacgggctttggcggctgaatgaatggaactattcagatgctgaacttctgagcctcattgaatggtgtatcgatcacggcatcacgacctttgatcatgcggatatttatggaggctatacgtgcgaaaagctgtttggaaacgcccttgccctttcgcctggattaagagaaaacatagagctggtcacaaaatgcggtatcgttcttgaatcgcctgaacggcctgctcacagatcgcatcattataacacaagcaaatcgcatattttggcatccgttgagcaatcgcttatgaaccttaggacggattatatcgatgtgctgttgattcacagaccggacccgctcatggatccggagggggtagcagaggcgtttcaggccttgaaatgctctggcaaggtcaggtactttggcgtttcaaattttaaagatcaccagtatcggatgctggaatcgtatttgcccgagaagctcgtgaccaaccagattgagctttccgcttatgaattagaaaatgtgctcgacggcactttgaacctctgtcaggaaaaacggataccgccgatggcttggtcgcctctggcaggcggcaaagtattcactggaaacacggaaaaagaccggcgtgtccgcacggcgcttgaatccgttcaagcagagattggcgccgcttcattggacgaggtgatgtacgcatggctgtatacgcatccggccggcatcatgccgattgtcggaagcggaaagcgtgagcggatttccgccgcgataaatgcgttgtcatacaagcttgaccaggatcaatggttccgcatttttacagccgtacagggttacgatattccataaaaagcatcagcttaccagctgatgctttttcaatattgtcacaccgcatagtgccaaattaccatttataagtgattgattctttcttgaaagcgttttatattaaagggaaacctctctatatcctctactgcatctccttgcgacttcatccgcacatcaagatagtctaggaggtcttttttatgtatatgactgccagagaacaaaagctgttaaagcacttattattacaaaacagatatataaccgtaactgagcttgctgagctgatgcaagtcagcacgagaaccattcacagggaactcaaatcaattaaaccgctgatggaaaccgtggggcttacgttagataaacagcccggtaaagggttgaaagcagtgggaagtcccgaagataaacaaaagctgcttactgatttatcatatgaacagcatgaatacagcgccgacgaacggaaactgctcattctttgttcgttattagagtctcaggagcccgtcaaactgtacacgcttgctcatgatctccaggtgacgaatgccacggtcagctatgacttagatgagctcgagaagtggatttctcccttcggactgacactgatccgcaaaagaggttttggcatccagctcatagggccggagaatgcgaaacggaaaattgtcggcaacttgattgtgaaccgtctcgacatccaaatgtttttggaagcggttgaattaaacatcaaaggaaaaaccgattcttcagagaaaatgttcggggttgtcagcaaaggtgagctgttaaaaatggagcgcatcttatttcagctcaaagaaaaaatcgctttttcattgtccgacagctcctatatagcgctcgtcgtccatctgacgtatgcgatcgaacgaattaagcttggggaaactatcaccatggagcaaaatgagcttgaggaactgaagaatgcgaaggaatacagctccgctcttgaaatcgcgggcgagcttgaacgtgccttcggcgtgacgattccagaggcggaggtcggctatattacaatccatcttcgaagcgccaatcgaaaatacaaaacagaatacaaagcgcaggaaattgagctggaaacagccctgcaaacaaagcggctcattgcttttatttcagacaaaatcagaatggatctgacgaaaaactactctttatatgaaggcttgattgcccatttggagccggccgtcagccgcataaaagaaaatattgagatatacaatccgatgaaggaacagatcaagcgcgattattttctgctttatatggcgatcgaagaaggcgtcgaaaagtattttccgggcatgtccttttctgatgatgaaatcgcttttatcgttcttcactttggctcggctcttgaaatcaaaaaagaagaagcaaaagtgaaagcgcttgtcgtctgctcaagcgggatcggctcctcgaaaatgcttgcctccagactgaaaaaagagctgccggaaattgaatcgtttgatatgtcatctctgatcgagctaaaggggaaggatgttcaagcctatgatatgattgtgtccactgtaccgattccttatgaaaacattgattacatcatggtcagcccgctattaaatgaggaagacgcaaaccaggttaagcagtatatcaagcggaagattccccttattcttaacaaaaaaagaagcccgaaggaagaggcgcagcaagctgatgtacctgacatgctagaggcggcagaaagcatagggcggtatatggaggttatccaagatgttctgcgccattttacgctagctccactcaaaacaaacccggaccatagcatgcttctgctagagctttttcaacagctgaagaaagatggcctgatccgtgatccggaaaaagccgcggtttgcctggctgagcgggagaaacaaggaggattaggaatccccggaacaaacatggcgctttatcatctcaaaaatgatgaaatcgtcctgccttttttcaaaatgtttgatctcagcacctcctatgaagtggatggcatggacggaaataccctcaggatgacacgcatcctcgtcatgatggcgcctagctcattatctgctgaaggctcggagattttaagcgcgatcagctcggcaattatcgagagcggagaaagcatggcggggtttcaagaagaaggagaacaagaattgtatcagcggttaaaccgcatatttttcacatggatgaaagaaaaaaacatactgtaaacctgcatggcacacgtcaaaaatttggcgtgtgtttttctgtggatggggaacaaaataagaaaatgtgggactattttatcattcagtattggaataattccaaaatgaaatagttttacaagttatcttttttgggttaaaatgggtgaggtaaggaagaaaatctaacaaattattgaagattcaagaaaatataggagatgacgatatggaaacattacagcatctgattctgcatgacatgccgaatagcgaagaaatagaggctgtaaaaagcggagaccatacactgacatataaaggttaccgtaaacggattaatcagctggcgaatgccatgcttcaaaaaggaattcaaaagggcgaccgtgttgcattgctttgcaaaaacggccatcccgcctcaacagttatgttcgccgcacttgaaataggtgctgttgtcgtacctgtcagctggcagctgaaaccatatgaaatgacaggcattttaaaagcaagtgaaccgaaagcaatgttttacggagcggagtttaaagagacactggatgaagttcttcctgaattgtcctcactgtgtgtaataatggaaacaggaacagcttacgaaacatctgctgaatttgaagcgctgtttgcaggtcctgatcatttgccagagacggaaatggtttcccctgatgatacagcacttctgatgtttacatctggaacaacgggtaacccgaaaagatgcatgattacacatggcggcatatacagatacgttaaaaaatccaacagctcaatagcacgcatgaagggccttcgttttctcgcgtgccatccgatttatcatacgagtgcgctcatttgcatcatgcttggaacgtttgcagaaacaacctttgtgtttacaaaggatcaagatcctgttcacatgctgaaggtcattgaagaagagaaaattcagaccgtgatggctcttcctgtgttctacacgtatttgcttgaggcgtgggaaacgcaccaaactgacttatcttcgcttgttattttaatgacaggcggaacaaaagtgccgagcagcctaatccgccgctatcttgatattggcattccgcttgcgcatggctatggaagtactgaggcttggggcatcagcacatggacgcctgatatgggaatggataaagcggcatctgcaggaaaacctgtggcaggtgttaaagtcaaagtggaagatcctctgactggagaagaacttcctcaaggacaaatcggcgaaatcgttgttcatactccattcttatttaaaggctatgaagacaatcctgaagcaacagcgaaagtgctgcaaaatggatggtttagaaccggagattcaggatatgtagatgaagatggctttattttcatcacgggacgctacaaggatgtcattatttacggaggcgataacgtctatcctgatcaggttgaagaagttatccagcagatcccgggaatccttgaaacggctgtggtcggtattccagacccgctttacggtgaaaaaccgaaagcttttatcgtgaaaaatggcggccagcgcatcacggaagaggatgtcatcgcattttgtaaagaacgcctgtccgcttacaaaatacctgaagttgaatttgttaacgaactgccgaaaaacaaccttggcaaggtgaaaaaagacgtcctgcgcaatcaggctgtacattcataaaagaagaagcccgtccactttatgtggcgggcttctttgcagttgcacagacggaaagctcaggcttaatgttcttaaattctatatcaatgtcttcgaagccggctgctttaaagtcagcaatcatctctcttccaaatgatttggttttctcaggactggcatccgcttcccgcggctgcatcgtaatggctgctttgccgcctggctttaatgcccgataaatctgtttcatgccttttgtttggtcattccaaatggtgtagttgttaacggaaatcactttatcataaaacgaggcggggagaggaaatgtctcgatgcttccttgtatcaggcgtacgccctttggtttcactctgcgggcggccagcttcagcatggcctctgacacatcaatcccatgaagatgaacatccttctcccgtttcagcatctgctgcatgcagtatcccgggccaaacccgacttctaaaatgctgtccccgcgcgtgatacccagctgattgattgtccactgattcagtgtttgattttcagcagccatgatgtacccggcaatcatgccgatgacgccctttggcctgctgaatcttctagaaagcatgttaatcattcagcaaccaaccccctttttgagttaatttcctcccagcgttccatgtgaaacatttttctgataaagcaatgcgaaggtgccaagccatgtttatccaaagagtgtgtgaggtacacaacaaatagacatgaaaacaaaggaggagaatcatcatggcaaattatccaaaagaactgccggcacaaactcaaagtcgccagccgggaattgaaagcgaaatgaatccaagtccggtgtatgagtacgaggattataaaggagcagacaaattaaaaggaaaagtagctcttattacaggcggcgacagcgggatcggacgcgcggtttccgtcgcttacgcaaaggaaggcgctgacatcgccattgtgtataaggatgagcatgaagacgctgagaagacgaagaaacgtgttgaacaagaaggcgtaaaatgcctgctgattgctggtgatgtaggtgaagaggaattctgcaatgaagcggttgaaaaaacggtcaaggaactaggcggccttgacatccttgtcaacaatgcaggtgaacatcatccgaaggaaagcatcaaagatattacgagcgaacagcttcaccgcacattcaaaacaaacttttattctcaattttatttgactaaaaaagcaattgattacctgaaaccgggcagcgccatcatcaatacgacatccatcaacccgtacgtagggaacccgacactgattgattatacagcgacaaaaggggcgatcaacgcctttacaagaacaatggcgcaggcgcttgttaaagatggcatccgtgtaaatgcagtcgcgccgggtccaatctggacgccactaatcccagctacgttccctgaagaaacagttgctcaatttgggcaagatacgccgatgggccgtcctggacagcctgttgagcacgtcggctgttatgtgctcctggcatcagatgagtcctcttacatgacaggacagaccctgcatgtcaacggcggaaactttgtgacgacataagagggagtgagacatatgggcatcacgaaagaagaagtgaacagctactatcaaaaagcagggattgtattaacggacgaggaagtagaccaaatccagctgatggattacggcttaggaaaagaaagaaaagtcgggctccagctcttcgtctacgtcaatacagaccgttattgttcaaaggaattggtgctgtttccgggacagacttgcccggaacaccgctatccgccggtcgacggccaggaaggtaagcaggagaccttccgctgccgctacggaaaagtgtatctttacgtagaaggagaaaaaacgccacttccaaaagttctccctcctcaggaagacagagaacactatacggtttggcacgaaattgagctagaaccgggcgggcaatacacgattccaccaaatacaaagcattggttccaggccggggaagaaggtgccgtcgtgacggagatgtcatcgacgagcacggataaacatgatatctttaccgatccacgaatataaggatgggcttaacagcccatccttttttgtattgaaaaaaatagaatcatcgctataatgggtaaaaaaggaaagagggcgaggcaatgttcacttgcaaggtaaatgagcaaatcaccatccgattattggagccgaaggatgcggagcggctggccgaactcattatccaaaatcagcagcggcttggcaagtggctgttttttgcggaaaatccaagcagcgctgaaacgtaccgagaaaccatcattccagattggcggcgccagtatgccgacctgaacggaattgaggcggggctcctttatgacggcagcctatgcggcatgatcagcctgcataaccttgatcaagtgaatcgcaaggcggaaatcggatattggattgccaaagaatttgaagggaaaggcattattacagctgcctgccgaaaactcattacgtatgcttttgaagagcttgagctgaatcgtgtggcgatctgtgcggctgtcggaaacgaaaaaagcagagcggttccggagcggctcgggtttctagaggaaggcagggcacgggacggcttatacgtaaacggcatgcatcacgacctcgtctactacagtctgttaaagcgtgaatgggaaggtgaaaaataaagagcacactttcttgtttaaatcttccccggatgtggaaaagtaacagcggagacgttaaaaaggagtgattagagatgaatcagcaagacattaaacaaaaagtgcttgatgttctagatcaccataaagtaggttcgctcgcaacagttcaaaagggcaaaccgcattcccgctacatgacttttttccatgacgggctgacgatttacacaccgacaagcaaggaaactcataaagcggaagaaattgagaacaaccccaatgtccacattttattaggctatgattgtgaaggctttggcgacgcatatgtcgaagttgccggaaaagccaaaatcaacaattcggcagaactcaaggacaaaatatggagttccaaattagagcgctggtttgacggcaaggatgatccgaatctggtgattcttgaaattgaaccggaggatatcagattgatgaatgccggggagaaaacaccggtctcactcgaactataaaaaatttgtgttttcaggggcgatatgttattatgaatagctagtaagaaaaataagcaaataaaaaagaaagtaaacttcttttttctgttttgagagagaagcttaccgcttcccaagcagcataaccagctgcccttattcttttccttcataacaaatcgcccctaacgatgagatggaaaaaagacttttttgttttacaattcacaccggcgcggcttcggagccgcagtgacgattgagaggtagggctttcgttgtcttgtgttcaagaaatttccatggtgtttactttccagaatgattcttcggaacaatgctttatgaatctaacccgcctgacttggcggatgatataatctttatttgcgtatagaaaagaataagacaaaccgcccggcgtacgccggacggtttttttattgcaaaaaacacatcgtactgaaacctccttgtcttctttccagtcttatctctaggatgaaattggaggaagaataacgtgcatgtcattacaacacaagtactttttattttttgttttttattgctgattcactcgatagaaaccttagcctatgctacaaggctttccggggcccgcgttggatttattgcgtccgcgctttccctgtttaatgtcatggtcatcgtgtccagaatgtcgaacatggtgcagcagccctttaccgggcatttaattgatgatgctggaaaaaacgcactggcgattgtaggggagcagttccgctttttaattttcggatcgacagtcggcaccattttgggcattatcctgctcccgtcttttgttgctattttttcacgggcgattattcacttggcgggcggcggcggctccgtttttcaagttttccgaaagggattctcgaaacaaggattcaaaaatgccctttcctatttgcgtctgccgtctatttcatatgtaaaaggatttcatatgcgcttgattccgaagcgtttgtttgtcatcaacatgctgattacatcgatttatacgattggcgtgctttcggctttatacgcaggccttctggcgccggagcgcagtacgacagccgtcatggcttcgggtttgatcaacggaattgcgacgatgctgctggccatttttgttgatcctaaagtatccgttcttgctgatgatgtggcaaaaggaaaacgaagctatctctatttaaaatggacctctgtcacaatggtcacatcaagggtggcgggcacactcctcgcccagctcatgtttattccgggggcctactatatcgcgtggctgacaaagtggttttaataaaaaaggctggatcataaaaatccagcctttttttgcgttcccttatttatatttccttaatccgcggtcgtacaaaaaatttccgaatgggacgaaagcggcgatgaagccggcagctgaccatttcagcggccatttgacagagaaggttgcataagccaagacaagcaaatacaaaatgaacaacccgccgtgaaccgaaccgacaattgtcaccgcaagcgaaaggcctgcccaatatttaagcggcatagcgatgaacaacaggattaagagtgacattccttcaataaaacccatcgtgcgaagtcttccaatcggcgtgtgcagcataaatcgccctccttgtggacacgttttcattttatactataaacaatccggaggggcatatgacagctttcaaaaaatgttcggaaaacattcatttttacatgccttttctagggaactgtacttgtcatttacaaaaatacccgagataatgtgtacaaaatcaaaaaagaaggatgttgaaatgaaacttgaccagattgatctgaatatcattgaggagctgaagaaggacagccgtttgtcgatgagggaattaggcagaaaaattaagctgtcgcctccatctgtgacagaacgggtaagacagcttgaatcgtttggcatcattaagcaatacacgctggaggtcgaccagaaaaaactggggcttcccgtttcctgcattgtggaagcaaccgttaaaaacgcggattacgagcggttcaaaagctatattcaaacattgccgaatattgaattttgctaccggattgcgggtgcagcctgctatatgctgaaaatcaatgccgaaagcctcgaagcggtagaagatttcattaacaaaacatcgccctacgcgcaaaccgtcactcacgtcattttctcagaaattgacacgaaaaacgggcgcggttagagagtgccgcgtgaagtctgttataataacaggatgagcgcgaaagaaagagaagtgatcaagcatgtcaaaaacagttgtattagctgaaaaaccttcagtcggccgggatttagcccgggtgctgaagtgccataaaaaaggaaacggttatctcgaaggcgatcaatatattgtgacctgggctttaggccatttggtgacgcttgctgatccagaaggctacggaaaagaatttcaatcatggcgcctagaggatctgccgattatcccagaacccttaaagcttgtggtaataaaaaaaaccggaaagcagttcaatacagtcaaatcccagcttacccgtaaagacgtcaatcagattgtcatcgcgactgacgcaggccgggaaggtgagcttgttgcgcgctggatcattgagaaagcgaatgtccgaaaaccaatcaagcggctgtggatttcatctgtgacggataaagcgatcaaggaaggttttcagaagctgcgcagcggcaaagaatatgaaaacctgtaccattctgccgtcgccagagcggaagcggattggattgtggggatcaacgccacccgtgcacttaccacaaaattcaatgcccagctctcatgcgggcgtgtgcagactccgacgcttgccatgattgcaaagcgtgaggcagacattcaggcgtttacacccgttccgtattacggcatacgtgctgcagtcgacggcatgacgctgacgtggcaggataagaaatcaaagcagacgagaacgttcaatcaagatgtaacaagccgtttgctaaaaaacctcgacggaaagcaagcggtcgtagctgagctgaaaaaaacagcgaaaaaaagctttgcgcctgcgctttatgatttaacggagctccagcgtgacgctcacaagcgcttcggtttttctgccaaagaaacgctttctgtcctgcagaagctatatgagcagcataagctcgtcacatatccgcggacggactctagatttttatccagtgacatcgtcccgacgttaaaagaccgtctggaaggcatggaagtaaaaccgtatgcccaatatgtcagccaaattaaaaaacgtggcattaaatctcataaaggatatgtcaatgacgcgaaggtgtcagaccaccacgcgattatcccgaccgaagagccgctcgttctcagcagtctgagtgataaagaacgaaagctgtatgacctgattgcgaaacgtttcctggctgtattaatgcctgcattcgaatatgaggaaacaaaggtcatcgcagaaatcggcggagaaacctttacggcgaaaggcaaaaccgtgcagtcgcaagggtggaaagccgtttatgatatggcggatgaggatgatgagcaggaggatgacagagaccagacacttcctgcgcttcaaaaaggcgacacacttgccgtccgcacgttaacggaaacaagcggccaaacgaagccgcctgcccgctttaacgaagggaccttgctgtcagcgatggaaaacccaagcgcatttatgcagggagaagaaaaagacctcgtcaaaacgcttggagaaacaggcggcctcggcacggtggcaacgcgtgccgacattattgaaaaactgttcaacagctttttaatcgagaaaaaaggccaagatatttttatcacgtctaaaggaaaacagctcctgcagcttgttccggaggatctgaaatcaccggccttaacagcagaatgggagcaaaagctgtctgcgatcgcggccggcaaattgaaatcggctgtttttattaaagatatgaaggcttacgctcaccaaacggtaaaagaaatcaaaaacagcagccaaaccttccgacatgacaacatcacgggaacggcatgtccggaatgcggcaaaatgatgctgaaagtaaacggcaaacgcgggacgatgctcgtgtgccaagatcgtgaatgcggaagcagaaaaacgattgcccgaaaaacaaacgcacgctgcccgaattgccataaaagaatggagcttcgcggccaaggcgagggccaaacctttgcgtgtgtgtgcggtcaccgtgaaaagctctctgtatttgaaaaacgaaaaaacaaagacaaagcgcgtgctaccaaacgggacgtatcctcttatatgaaaaaacaaaataaagatgagccgattaacaacgcgctggcagaacagctgaaaaaactcggtttggataaataataaaaaaacctgtgcctatcgcacaggtttttttattggacttaggtcctgttttcttaatgttcaaaaagggaaaaaaaagctagcaatctgcatttttttcttttatagtaaatgtactttgtaacgtggcagtcatattttcgtctataactatttgtgagcgtctgatttgcttcaggcgacaaagggggatttgcctgtgaggcatgtactaattgctgtcatcttattcttcttatctatcggactttccgcagggtgtgctgaagctggaaacaagacccaaaatcagtcggcgacagaagtgaaagtcagcccgctccagccggcggaatatttcatctatcacaatttaatgaatgaccaagggctgatcaaaaccgatttttcagaccagccttcttacttgtcggaatctctcggcctgtggatggagtttctgctcagcaaaaatgacgcaccgcatttccaggatcaatatcagcatctgactgattcatttctgatgagcaatcacttggtgacgtggaagattcaaaatggccaagcgagcgggacgaatgcgctgatagatgatatgagaattatgctgtctcttgaccaagccgccgcaaaatggggccgcagcgactacgcgcaaacggctagggatatcggcacgtctttgaagacatacaatatgaacaatgggttatttacagactattacgactcacaggccgcttcaaaggatgtgacgctttcatacgtcatgcctgacgccttagctgtcttaaagaagaatggaatcatagacgaagacacagaacagcggaatgccaatgttctctattcagctcctttaaaaaatggctttctgccgaaaacatacagctcggagacgaaggaatacacatacgacagtgaaatcaacctgattgatcagctttacactgcttggcatttgccggaaggggatgaaaaagcatctgttttagcggactggatcaagcaggaatttcagaaaaacggaaagctgtacgggcggtattcggcagatacgaaggagcctgccgtccaatatgagtctccatccgtatatgcattagccgtattgtttttgacaaaacagcatgaaaacagttctgtcatcaaagccatatatgacagaatgaatgactttgaaattcatgatccggtgaaatcgtattatggaggctatatgagcggcactcagacgcattcatttgacaatctgctgccgctgttagccgaaaggaagctttttaatgaaaatatcattcagtgaatcacaaaaattatttgcttatttttcagggctcatcgcggccctgtctctgtttatttattatgtgtcagcccagcaatcggaaggtgctctgatcctttgcatcacatttgtcgtcatcgccacaggcatctggttcggcccgatttacgcgctggcagtgaccttaatcgtactctttgttctcggcaccttaatgatgtttttccagactggacagacatcgctctttccggctgaggaagggctgcgaatgcttgtcgtgtggggaatcgcgcttttgctgttttcttttatttctggacgaatccacgatattacggcagagcttcggcgctcaatgacacggcttcaatccgaaatcaaaagctttgttgctgttgacagagtgaccggttttgataacaagcaaaggatgaagctggaactttcagaagaaatcaagcgggcggagcgctatggcaattcttttgtgtttttgctgctccatatgcattatttcaaagagtttaagtctttgtacggtgaaaaagaaacggaccgcctcttccaatatgtcggtcagcaaatcaggacaagcgttcgggaaacggataagaaattccgtccctctgacgagcgtatcgggatcgtgctgacgcacacgcctgctgaacatatgccggccgttctgaccaagctgaagaaacaattggatacatatcagctggaaaatggaaagtatgtgtcgcttacgttccacgtttgctatttgccctaccgcaacgatatcaaaacagctgatcaatttttagaagaactggaaaacgagatgatgatgaatgaactataaaggaatcacattgctatgcgtcatgatgtttctattttcagctattgcgtcttttcccgtttctgcgcaagcaaaagatcaggatgcaggcattctcatcatctactcaaccttggacggcaaagagtcgtcacaagtcaaaatgctcgatttgcttgcaggccactttacatcccatgtgacagtcaaaaaagattcagatgttgaagcgtcggatttcaaagggaaagaccatgtgatttattacggccaaacgaaaagaaagctcagaaaaaaactggtgtctcttatcagcagcgtaaaaaaaccagttgtcgccatcggctataacgcaggccaaatcagccagttttccgggctttcattagcccggaaagaaaatgtgtttcaggtccacagcaggtcggaaaagaccgatgtgtctctagagagcgggcttaacgtgctgagtgtatcaggcctgaaaggaacggcgctttacaccttcaaagccgatgaaggcacaacgcattcttttatatggaaaacaaaaaaagggaatgtgtacattggattaacaaatttgttaaatgacaatttgatcgtggcgaaacagctcagagaagctttcggagagaaggcggggacgacgttattgtatttgcgtctcgaggatatcagcccgatgtctgatgaaaaactgctgcttcaagccggcacttacctgcataagcggcatattccttttatcctggcggtcattccggtttacttgaatccggaaacaggcgacaaagtgtatttgtctgatcaaccgaagatggtcaaggtgctgaagaagctgcaaagcatgggcggcagtatcatagttcacggctatactcacgcttatcgctacagtgaaacaggagagggctttgaattttgggatgcaaaggcggatcagccgattacatccggaaatgccgaagaccccccatccattttggagaaagaacaggacttcccgaacgaacaagcctatcacagctatcttgaaccatttcgggaaaaggaagaaacgtatacaaaacaaaaactgacgcgtgccattgaggatttgacatcatcgggtctttacccgctggcgtttgaagcgccgcattacacgatgtccgaatatggctatcaaatcgcctcgcagtattttacaagcattttcggccaggtccagctcagcagcacaacatggaaaacatccggtgcacctccgtttgtgactgctccttcgatgttgcacggaatgacgctttatccggaaacgatcggctttgtcgacacatcaaagcaaaacccgctcggtgagatggaggagcgcatctcccagatgattgattttgaaggcggagtagccggaggattttatcacccgtaccttgggatgaaatatctgcctgagctggttgatcagatggaacgcattccagacagtgaatggcttgatttaaagaaaacgaaacaaaccgtcaaaacagacaaagtggaaattcatacaagcggtgacggaacgattcaggtgaaaaacggtgtaagccccattgacgagtttttcgatcatcaccggcaaacccctctggaaaaggcgttatggattctctccgctgttgtgctcttatttgtcatcatgtttgtcagttatacgttttacttgagagccacattgaaaaaacgaatttttaaggagagaagaagccttgggtaatacgctgttctttatctcgctaagtttaatatgggttatgcttctctaccacatgttcctcatgcagggcgggtttcgccactatatgaccttcgaacggaatatcccaaagtggagagaaaacatgaaggaactgccgaaggtcagcgtccttatcccggcgcataacgaagaggttgtgattcggcagacgctgaaggccatggtcaacctttattatccgaaggaccggctggagattatcgtcgttaacgataattcatcagaccggacgggtgatatcgtcaatgaattttccgagaaatacgatttcatcaaaatggtgattacgaagccgccaaatgcaggaaaaggaaaatcctctgcgcttaactcaggttttgccgaatcaaacggcgatgtgatctgtgtgtatgacgccgacaacacccctgagaaaatggccgtgtattacctcgtgctcggcctgatgaatgacgaaaaggcaggcgccgtggtcgggaaattccgcgtcatcaatgcagcgaagacgctgctgacgaggtttattaatatcgaaacgatctgttttcagtggatggcccagggaggcagatggaagtggttcaaaatcgccacgatcccaggcaccaactttgcgatccgcagaagcattatcgaaaagctcggaggctgggatgacaaagcgctcgctgaggatactgagctgaccatcagggtatataatctcggctaccacatccgctttttccctgccgccattacgtgggagcaggaaccggaaacatggaaggtatggtggcgccagcgcacccgatgggcgcgcggcaatcaatatgtcgtgctcaaatttttggcgcagttttttaagctgaaacgaaaacggattatctttgatttgttttattttttctttacgtacttcctgtttttctttggcgtgatcatgtcgaatacgatttttgttgtgaatttgttttatgatttgcatttatcggttggatttttggcaatgattctctggattttggcatttttcttatttatgacagaggtcatgattacgttgagcattgaaaaaacagaaatgaacaagcaaaacttttttatcgtatttctcatgtacttcacatactcgcaggcatggattgtgcttgttatctactctttatttgtagaaatcaagcaccgtttattcaagcaagaggtcaaatggtacaagacagaacgatacaatcaacataaaagcgggtgacctttttgaaacaaataatgatttttctcacaagcttcatgctgctggcgatgactggacaaacggctcttgccaaagacgtacaggtcagcggttcgctcctcgggaaaagcagccaagaacaagccaaacagcaggtgcttacaagcgagctgattacactgtatggatcaaaagacagcgcagagctgacgtatcagatcccggcaggcgcttcttcaggcaatcagcaattggtaatcgaatacgaggcatcaaatcttttaatttctccatcatcgttaacggctgtcattgatgatgaaccggtcaagacgttaaagcttgatggtgattccaaacggaaaacagtgaagctgaatctgaataaaagccagtctgcgcaaggctatcacaacgtatcgttgaaattctacggcgtaatgaaagagggcgtgtgcgtcagacaggatacatcaggcaactggatcaaaatttatccggacagccggctgacacttgctgacagcagtgaagaagcgaagggaacgtcgctggaccattatccgtatcctttcgcccaatctggaaatacagcggaagaaacagctatcatcattccggataacccaagttcagcagaaatagaagctgctgttaaaacagaaggctatttgaaaacggtggacagcagtgtcagtattgcgtatgtcacggaatctgaactgaaaaaaatcgataagccgacgattgttatcggcgtggacaagcattggaacggcaaagtgaaaaaactgttgaaacaagctgggctacaggcaaaaggagaaaaccttctgcttgcggagcgggtgctgaaagcagagggcaaacagcagccggttctgtttgcgcaagcggcgtccgaggacgcgctcactaaaaaaatcagcgtgatgacagatcagacatatacaggccagctcagcggcgatacactttcaatcagcaagcttcagcagactgaaaaaaaggaaagcgataagctgacccttgagaattttggagcgggcgatatcacaattggagctgacaaaacatcttcagcacattatttttatccggcttcggctgttttagatgaaaaccaatcggcgaagctgtcgcttaaactgaaaaagtctgaaacgattcaagcctcaacggctgaaaaagaatcagtctctcaggctgcagaactgaaagtgatgatcaacggccagccgcactcagtccggcttgatgaattaggaaaagaagataaaaacggattctatcatgtcacggtgaaagtggaccctaagctgctgcaaaaaaaccgctacattgatattcagttcgtcacgaccggtttaaaggaaaacaacccttgcaatacgactgatgaagaaaagtgggtttttatcgataaaaacagtacattatcatacgccatcaaaggcatgtctccgtcagcggattttcaagagtggccgcttccttacgccggaaaccaggatcaaacaacgttaatcgtgcttcctgacaccgtaagccaatcgaagcttgaggagctttctctcgtgacggaatcctttggcagcgaagcacagcattcatatacggtaaagaaatcatctgacgttacagcaaaggatgcgaaaggacgaaacctcattttcataggagggatcaatcaattttctcttctgaaggagaaatcatcagatctgcttgtgccgcaggaaaagaacggatcgtttgatgtatctggtttcgagatgctgaatgagacgacaaaacaagtggtatttacccaagcatcggtttgggattcacgctatacaatggctgtctttgcaccgtcaaaaggagatggcacggctgtcacaaaagagatcatcagttatctgaacagcaacgatgagtcggcaaccgtccttaatgaaacaaacagccagcaggtgtttacaaaccaccagcagctcaaatcggaaacaaacagttccgatgcagaacaaccaacacaggatcatagccagaaatggatgtatattggtgtgctggcactcattatggtgattgcggcagtattcatttggattgccgtaagacgcagaaaaagaaagacagatacagaataaaacagaggcgattttagcctctgtttttttatttttggtaagtaaattccatttgtggaacctgtcattttatttttttctctcagccaataagcctctttacaacgtgcgggaacgggagtatgatctcttttagaaaacaaatcgcttaatctgaaatcagagcgggggacccaatagaacggctttttgccgttggggtgaatcctttttaggtagggctaactctcatatgcccgaatccgtcagctaacctcgtaagcgttcgtgagaggagatgaatgaaacctgtgttcgatgttatggcacaggggcatccgtttgcctctgtgttttttgttgttcatttttgaatgcaaatcgcatacagagacatcatagcagaaaggactatcaacaacatgtgagagcaagacactgatgttttattgttttaattgaaaaatgagaaattaaaaggggaagacatcgatgtatcattcaatcaaacgttttttgattgggaaaccactaaaatcccaagcagctggagagcaaaaactgacgaaattaaaagccttggctatgctttcctcagatgcgctgtcatctgttgcatatgggacagaacaaattctaatcattttggcaacaatcagtgctgccgcattttggtactccattccgattgcggttggcgttctcatattactgctcgcactgattctttcatacaggcaaattatttacgcttatccgcagggcggcggggcgtatgtcgtttctaaagaaaatctcggtgaaaaaccgggattgattgcgggcggttcattgcttgttgattatattttaacagtagcggtaagtatttccgccggcacggacgccatcacgtcagcctttcctgcattgcatgattatcatgtgccgatcgctatttttctcgtgttagtgattatgattttgaacctgcgcggtctttcggaatcggcatccattcttgcctacccggtttatctgtttgtggtggcgcttttggttctcattgcagtcgggttgtttaaactcatgacaggacaaatagaccagccagcccatcatacaccgctaggcacacctgtagccggcattacgctgtttttgctgcttaaggctttttcctccggatgctcagcgttgaccggggttgaggccatttctaatgcgattcctgcattcaaaaacccgcctgcgcgaaacgcggcaagaacgcttgcgatgatggggattttgctggcaatcttgttttccggcatcacggtgctcgcgtacgggtatggtacggcgccgaagcctgatgaaacagtggtttcacaaattgcatccgaaaccttcgggcggaatgtgttctactatgtcatccaaggtgtcacatcgcttattttggttcttgcggcaaatacgggattttcagccttcccgcagcttgccttcaacctggcgagagaccagtatatgccgcgaatgtttacagtcaggggcgaccgcttaggcttctcaaatgggattatctttttaggctttgcctccattgttctcattatcttattcggaggacagacggagcacttaatcccgttatatgctgtgggcgtatttattccatttacgctttcacaaaccggcatgtgcatgaaatggatcaagcaaaaaccaaaaggctggatcggaaaaatgctgatcaactcctgcggtgctctgatatcgtttatggttctatccattctgtttgtgacgaagtttaatgtcgtatggcctgtgttaatctttatgcctatcgtcgttttgctgttttttgcgattaaaaatcactatacagcggttggtgaacagcttcgcatcgtagacaaagagccggaagaaatcaaaggcaccgttgtgattgtgcctgtggccggtgtcaccaccgtcgtgcaaaaatcgattcactatgcgaaatcactgtccgatcaagtgatcgccgttcacgtgtcatttgacagagaacaggaaaagaaattcgaaaaacgctgggaagagcttaataacggagtgcgtctcgttacgcttcactcctcgtacagaagccttgtccatccgtttgataagtttttggaaacagttgaggcaaaagcgaagaaggagcagttttccgttatggtgctgtttccgcaatttataacgaaaaaacgctggcacaccatccttcacaaccaatcggccttcctcctcagagtccggctgttctggaaaaaggacataatggttgccacactgccgtatcattttaaaaagtaaagctctaggaccaagggaatcaccttggtccttttttgcgggaaaaggaggtatggcggtgtatacacaaggtgcttttgtgatcgtattgaacgaaagtcagcaaattctgctggtgaaacgaaaagatgtccctctatgggatttgccgggcggcaaggttgatcccggggaattggctgaggaagcggcagtgcgggaggtattggaagaaacgggatacaatgcagcgctttctgcgaaaataggtgtttaccaaaggccaaagtttcaagatgaacagcatctgtttttcggaagcataacaggcggacaagcagtggctgacggcacagagacagcgggattaaagtgggtttccccggggcgtttgccgctttttatggtgccgaatcgaaaaaggcagatcaatgatttcaagaacggcgctcaagatgtaaatgtcaccgtcaaggatagagggttgctcgcggcgatcgacctgttgaaaagaagactgggcaagtgattcaggtctccgggttttaaagcctttctcctgtggtattgaaaaaaggaaaaaggaggatacgttatggcacataaaactgcaggacaagtaatgacagagctgcttgagcaatggggagttgatcatgtatacggcatccccgagacagtataaatgagtttattgaagaattaagacacgaaagaaatcaactgaagttcattcaaacccgccacgaagaggtagcggcactggcagccgcagctgaagcaaaactcaccggcaagatcggagtctgtctgtcaatcgcagggccgggagcggtgcacttattaaatggtttatatgatgcaaaagcggacggcgcccctgtgctggcgattgcaggacaggtttcttctggcgaagtcggacgggactatttccaggagattaagctggagcaaatgtttgaggacgtggctgtgttcaacagagaggtacatagcgcagaatcacttccggatctcttaaatcaggcgatcaggaccgcctacagcaaaaaaggcgttgcggtattgagcgtgtcagatgatttgtttgcggagaaaatcaaacgggagcccgtgtatacttcaccggtgtatattgaagggaaccttgaaccgaaaaaagaacagctcgtcacctgcgcccaatatattaataacgctaagaagccgattatcctagcagggcagggaatgaaaaaggcgaaacgggagctcttagaatttgcggacaaagccgccgctccgatcgttgttacactcccggcaaagggtgttgttcccgataagcacccgcattttctcggcaacctcgggcagatcggaacaaagccggcttacgaggcaatggaggaatgtgatttattaatcatgctcggaacgtcattcccgtaccgtgattatttgccagatgacacgccggcgatacagctcgattcagacccggcaaaaatcggaaaacggtatccggtgacagcgggccttgtctgcgattcggctctcggtctgcgcgaattgacagagtatattgaacgcaaggaagacagaagattcctgaatgcctgcacagaacatatgcagcattggtggaacgaaattgaaaaagatgagacagaggcaacaacaccgcttaaacctcagcaggtcgtggcccgtcttcaggaagcggcagccgatgatgcggtgctctctgtcgatgtcggcactgtgacagtctggatggcgcgtcatttcaaaatgaacgcgaaccaggatttcatcgtctccagctggcttgcgacaatgggctgcggcctgccgggagcgatcgccgcaagcttgtccgaaccggaacgccaggcgatcgccgtctgtggtgacgggggattttccatggtcatgcaggatcttccgaccgctgtcaaatataagctcccgatcacagtcgtcattttaaacaacgaaaatcttggcatgattgagtacgagcagcaggtcaaaggcaatatcgactatgtcacaaaacttcaaaatgtcgactatgccgcatttgcagaaagctgcggagcaaagggcatcaaagtgactaaagcggaagagcttgcgccggcattccatgaggcgctgcactctgaccaacctgttgttgtggatgtcatgattggaaacgaaccgccgctgcctggcaaaatcacctacgggcaggcgaaaggctttagcaagtacatgctgaaaaacttcttcgaaaaccaaaaatttgaaatgccgtcactgaagaaaagtttgaaacggttattctaaaaaaacagaggccccaaaaggcctctgttttttgttggaaacaaacgtattttcagctataacatgtttgaattcataaaatgatcggtgtatgtattaggaactgatttcgccatactcgaaacagacaaaagggcaaatgcatcttgtttcaaaggaagatgcatttgtccttgcatgcttattcttatcaaatcttacagagctcttctcagtatagggttatttctcttttttcttcagcccgaaaaagaaaggaaaagcagaaccgaccaagaaggtgccgaataaaaacatgccgccgataaacacgtgaaaattcgtgtgtccggctgtaaacgcggtgatcaaggaaatgacactgagcacgatcatggcaatgccgggcgcgactctcattttccccttggatttataggcagcgacagaacatataatgccgatgacaataggaacaatccacaaataaaacaaaataaatactgacatcatcaaaactccgatttttcttctatcataacaaatttctgtcaaaaagggtatcaatgagcttttgcgaaaaaataaaaaccggctttagaagccggtttttttatcgaaacgtatctacaattaaaaacacattcaaagcaacgatcaatacagcaatcagccaagacaccactgtgacccatttggcgttgatcagagatcccatgatccgtttattgcttgtaaacataataagcggaatgagggcaaaggcgatcccgaaggacagcacgacttggctcagtacgagagcggtcgtcggattaacacctgacgcgatgatcaagatcggcggaatgatcgtgataaaacgccgtacatacagcggaatgcggtagttgataaatccttgcataatcacgtcgcctgaaagtgtgccgacagacgaactggatagaccggcaacgagcagcccgatcccgaataaagccgcagacatagggctgacaagatgtccgaattgctgaaatgcgacgtcaagatcctcaacaaacaggccgtttttgaagaataatgcagcagccacaatcagcatacttgcattaatagcccctgcaatcagcatcgctattaaaatatcaataaattcaaacctaaagattttttttcgttctgcatcagttttgccaaccacccgccgctgtgtaagggcagagtgtaaataaatggcgtgcggcataacagttgcgccaagaatacccgctgcaagaagcacactgtcggtgccatgaaacgccgggacaaaaaggcccttcatcactgacacggcatcaggttttgcgaaaaaggtttgcagcgcaaaggcgatcacgaccacaaacagcataccggcaataccggcttcaagtgagcgataaccgcggcgctgaagctccaatatcgcgaaagaaccgatcgcagctataatagacgcttcaagcatcggaatgccgaacagcaaatacagtcccagagccgctccgataaattccgccagatcagtagcgataatgaccagctcgccctgaatccacaatccgatcgagacaggcttcgggaattcttcacgggcaacctcaggcaaatttttgcctgtcgcaataccgagtttggcggatagggattgaattaaaagggccatgatattagaaaataagatcacccataagagcatatatccgtatttagaacccgccgaaatattcgttgcgaagttgccgggatcaatataggcaatggctgctataaaagcagggccgagaaaagggagcagccctctgaatcctctgattttcccgtcaagcgcatcttggacggctttggaacggggagattgtgctgtgatgtccttgttcatcatgtctcacctgaattctgtttgtttttgccgtacaacaaagagtttccttgaggcaaattattttatctacatcatatgaccatcccggtttcttgtcaaccgaaaatgttcaaaatacacttctgaatttttccctgttatgtaacatgatatgtagggattcgagataaggtcccatataaaaagacaccgtttcagttcgaaacgatgccttctgtatctaatgagtctaggcttccttccgcagcccgcggaatataaggcccagcaagaatacgaagatggctgccccgatgatggccgggaaaatagcaaagccggcgaggctcggtccccatgtgccaagaagtccgtgcccaatccaagcgccgatcagcccggcaatcatagagccgaaaattcctcccggcagccggtttcctacaatggcgctcccaattaatccgataacaatagcaacaactaatgaaaccaaaaagctaagcatcatgatcacctctcataaatgatttaccaatcaataaccgctactgatcatttcgaaacacttaaaagcatattcctttatgatcctgttttaatctttctctgcacactgccgtcagctaaatgaacaatgacctaagtgcctttatgcgccgcgatttcctttgcccgttcaatcgcttctttctttgtatccttgatttcagacacgcgtttggcgccctcggctttgactgcccagccttttttatgcttaataacatgttctgctttgttcatgagctcggggccgctgccgctgcttggatcagcatcgcgttctgtctcatcatcatgcgtcaggaaatcatcaatttcatctgtagaggcgttttccgcccattccttcgctttgcttgtcgcaattggaatcgcgcgcccttcctcatagccttcatcaatcatcgcattcgcaatgtctatcgccttttttctcaccggcttctcaaggttttttaatgaagcaggataatccttcatcgaccaaggcatgtccatcactccttttccttttataaaaatggtacccgcaggtgaaaaataaaaacgcatccgaaaaaatgaaggtatactatatagtagaaaaaacggaagggaagtgcggattgggtgccaacagaacgaaaagaagacttacatcagcaattaaaagagatagagaaatgggaaaaagatcagcaaaaagtctggttttgggaaaagctcagccgtctcccgtttcagctactggacaagctgacaccggaattcatccagaaaaagatcggcaagctcttggatgaggtcggcagctttgttcaaacaggcggacagtacctgacatctgaaaaacagattatcaggatgtttcaaaagaaactgccggaggagatctttgaatcgctggaggacatccggaaagctcctcttcctgtcatggatgaaattgcggaaggaatgggcaaaaacagaaccaacgcagcaaccgttcaaggcgcgacaaccggtgtgggcggcgtgtttacgctggcggcagacattccggcagtgcttggcttatcactaaaaacattacaggatatcgcagtcgcatacggctatgacccaaaggagaaaaaagaacgcgtcttcattgtgaaatgcctgcagctgacgtcggctgatgttgtcggcaaaagatcgattttgcaggaattaaaacactacgatcaagaccgtacatataagaatgtcgcttctcaaatccaaggctggcgagaagtcgttttgggctatcgagacacgtttggctggaaaaaacttttccagatggtgccggttgccggaatggtttttggcgccgctgccaatcgctcaacattaaacgacattaccgagacaggcatgatgctgtacaaaaagaggcgcattcttgaacgactgaaagaaacagaacgagagatggaatagcagaaagcagacggacaccgcgatccgcctgctttttttagtggaaacatacccaatgtgttttgtttgtttaaaagaattgtgagcgggaatacaacaaccaacaccaattaaaggaggaattcaaaatggcagacaataacaaaatgagcagagaagaagcaggtagaaaaggcggagaaacaacaagcaagaaccatgacaaagaattctatcaagagattggtcaaaaaggcggagaagccactagcaaaaaccatgacaaagaattctatcaagaaatcggcgaaaaaggcggagaagccactagcaagaaccatgacaaagagttctatcaagaaatcggtgaaaaaggcggagaagccactagcgaaaatcatgataaagaattctatcaagaaatcggccgaaaaggcggagaggcaacaagcaaaaatcatgataaagaattctaccaagaaattggctcaaaaggcggaaacgcccgcaacaacgactaatcaaaagcataaaggcagacaacctgtaaataaaaaagcgatccggcacatcagctggatcgctttttttggaatcttctcaatttatgccgctattgcgatacaataagtgaaaaaggggttttcgctaatgtccaagatgcaaaacttgctcgccatcgcaaatgaagtcaaagaaaagcacgccaatttttcaatctcagaggtcaacgaccactgcgtgcgccttgcggtgtttacgggagaatatgactggcaccatcaccctgactcagacgaattgtttattgttcttgaaggggagctgctgatcgattttaaggacaaagaaaccgcggtgctcaaagcaaatgacagcctgctgatcccgaaaggcacggttcaccgcacacgctcttacgtcagaacggtaaatctctgtgtggagcataaacaagccgaaaccgtcctcatagaggagtagccatgctaatcaaaaagatgatatgtgaagtagacgctgcaaacgctgaagcatttgcaaaagcgcagttacagtggggagcattatcgtatataagcggctttatcaaacaggccggcggctggcgaaaaacgatagacgagccgctcaccgcagaaatcatcagtgtatgggaaaacagagaagcctatgatcattttatggagaacgaacatgacagcatatacgaggaaaacgatcagaaggctgtaattctttcgatagaggtgacggtgtacgaagaggataaaccgttcgtacacgatctgttgcataaccctgatatccggtacgaaccagactggacggttctgaaggcataatcaaagcccaaaacatcatgttttgggcttgtctctttactcgcgtcccggaagtgtattatgaacaaaaggcggtgctggttttaactccggtttttctccaaacgtttttgcttctttcacatattcaaaggcttctccgtccggcgctttttcattcagccagttttgctcggcgctttcttcgccttcagagaaattgataagctgatgtgagaactcttgtttttcgagcgctttcgggaatgtacccggcacaaccggaccttcctgtgcttctaattctttaatggcggcaagccattggttctggtgcatcgtgtcacgcgccagcaggaagctgagcatatctttgacgcctttgtcatccgtcatttcaaacaggcgtgcgacctgcagacggccctgagattccgcattcaggttggcgcggaagtctgccagcaggtttccgcttgctacgatataaccgccgctccaaggtacgcctgtactgctttccggcatggcgccaagtcctgatacaatcgcatggtgagggttcatgccgcctaggatggagccgatgaccggatcttcagcagctttttcctgctgatcaagaggggcatcctcaagaagtctggcaatcatcgttgcgatcatttcaacatgcccgagctcctcagttgcagtatccatcagcaagtccttgtatttttcatttcctcttgtgttccagccttgaaataagtactgcatggcaactgaaatttctccgaattgcccgcctaaaatttcttgcatttttttagcgaataatggatctggacgatctggtttagcaggatgctgcagcatttttgtgtgcttaaacatgtacccatctcctttttcgtttatctctttttatatttccgatcgatagaaagataaacgaaaaacagcgtatcgagatgggaactatgaatcttttcgcagctccaacagttcccggatcagctcccggccaaagatgggctcatactgccggtaaacagggtcaagacgcttcatccattcttgtttctctttatctgacagctcataaatatgtatagcagaattctttttgatttcttccagctgctccttgttcatttgttcggcatacgtttcattccactccgttgtctccttcatcgcttcagtcaaaatgcgtcttgtttctggtgtttgcgccttccagaagtgttcatcagtcatgacagcgtagccgagataaccgtggctgcttattgtcaaatagtcctgaacattataaaattttttagaatagatgtttgaaattgtattttcttcgccatcgactacattgttttctaacagctgaaaggtagaattgaaggattcctgatgaggtgttgcgccaagcagcttgaactgatcctcaatcacatcgctttgcataatgcgcagatcctgcccttttaagtcatccggtgttttgaccggcccttgatttgttgtgatttgcttaaagccgttcgtccaataggccaatcctttcaattggtttttctttagagaatcaaacagctgtgtgccgatgcttccgttcagcccttttttgacggcgttgtaatctgtaaatgcatacggcagatccagcactccccattcaggcgagagcatgccgagcttcgatgtggagggggcgataaattgaacatcgccgttttgcaatgcttcaatttcttcaatgtccgagtacaggcttccattcggaaatacttctatttttatttttccgcctgatttttcgttcaccagatcagcgaatttattggcggccagcccttttggcgtattttcagcaaccacgtggctgaatttaaacacgatttgatcctgcaggccttcctggtcgtcatcataaacaatctttttattgccggtatgatcatggaatccgataaataaagcggttgcaattccagcgatcatcagtgcgagacatgcaagcaaactcttcatgaaaagccctcccctatgttaaggataatgggggctatgacattcgtaaagacctgaaaggagaagctgatgaacaaaaagaagctctcaatccgttggaaaatcacgatcttatcctatatactcgtcattttctcctttttgatcggcggcattgtgctcatcggcaacattcagcatacagaggagcgggagctgaaaaagcggctgatgaatacggcccggacggtgtcagagatgacagaagtgaaagaagccttggcgcgaaaaaaacaaacagaagcggttcgccatgcggttgaagaaatcaggatgattaatgaagcagactatattgtcgtcatggatatgaatcacatccgatatacgcatcctgtcagcacaagcattggcaagaaatcagaaggtgcagacgaggaggcagcttttgcggagcacatttatttctctgaagcaaagggcgagatcggcacggcggttcgcgctttttatccggtaaaggatcaagacctgaaccaaataggcgtggtgcttgtcggaaaaacgctgccggggatcgctgacatcctgcttcatttaaagcgtgatatcgccttcatcgttgtgctgacactcggctttggccttgctggttcctttttgctggcccgccatatcaaaaaacaaatgtttcagcttgaaccccatgagattgtccgaatgtatgaagaacggacagcgacgtttcactcgatgaatgaaggggtgatcgctattgacaatcgtctcgtcattacgatcttcaatgaaaaagcgaaacagatctttgaagtgcagggggatctaatcggcaaggtgatttgggaggttctcaaggattcgcgcctgcccgaaatcgtggagcggaacaaagcggtttataatgaagaaattcgtgtcagcggtaaggtgatcatgagcagcagaattccgatcgtcatgaagaaaaaagtgatcggcgccgttgcgatttttcaggacagaacggaagcggccaagatggcagaggaattgactggtgtcagaaactttgtggaggcgctccgtgtccaaaaccatgagcatatgaataagctgcacacgatcgccggtctcatccagctggggaaatctgaaaaagccttgcagcttgcattccaggcgtcaactgagcaggaaaatgtgactgaatttctgcaccgctcgattcaaaatgacgctgcggcaggccttctattaagtaaaatcagaaggggaagagagctcggcattgctgttcatatagatgaaaacagcagtcttcagcaatttcccgagcatgttgatcagcatgatattgtcgtgcttttggggaatctgattgaaaatgccttcggctcatttgaaaccgttcaatctgaagacaaacgaattgacattagtatcgaacaaacagatgatatccttgctattttaatagaagataacggctgcggaattgaaccgacacatatgcctcgcctttatgacaaaggttttacggtcaataaaactggcggcacaggctatggcctgtatttagtgaaacaaatcatagacaaaggatcgggcacgatagaagttgattcacatgcggggcaggggacatctttttctatcgtttttccaatgaagggggaggaagcacagcatggctcgtaaagaatggaaggttctgctcattgaagacgatccgatggttcaagaggtcaataaggatttcattacaactgttaaaggcgttactgtctgtgcaacggcaggaaacggagaggaaggcatgaagctgattaaagaagaacagccggatctcgtcattctcgatgtgtacatgccgaaaaaagacggcatcaagaccttgcaggagatcagaaagcaaaagcttgaagtggatgtcattgtcgtctccgctgcaaaagacaagaaaacgatctcactcatgctgcaaaacggggcggttgactatatcttaaagccgtttaagcttgagcgaatgagacaggcgctcgaaaagtacaagcaatataaacaaaaaatcgaagcgaatgatacgctgtcccaggaacagctcgatgcgatcctgaatattccgcagcaggccgtacaggatctgccgaaagggttgaatcacttcacgatgaatgaagtcactgcttttttgaaacagcaaaccgcatccctttctgctgaagaggttgccaaggcgctcggcatcgccagagtgacagccagacgatatcttgattacttagaaaaaaccgggatcatcaaattggacgttcaatacggcggagtcggccggccggtcaaccgctacgtgttaaaaggataaacctgagaccaaaaagaccaaaatgtccgttatgatcataaacttccccagactgtatgaaaacgctatcattctagtaagaaagacacaaaaggcgaataggacagggggatgaaggatatgaaactgtttaaaaatttaacagttcaggtcataaccgcggtcatcatcggggtcattgtcgggctggtctggccgaatgtcggcaaagaaatgaaaccgcttggcgatacatttatcaacgctgttaaaatggtgatcgcaccaatcattttcttcacaatcgttctcgggattgcaaaaatgggcgatatgaagaaggttggaaaagtagggggaaaagcgtttatctatttcgaggttgtcaccaccctcgcactcattatcggtttatttgtcgtcaatattatgaagccgggtgcgggtcttgattacagcaagcttgaaaaaggagatgtatcacaatacacgcaaaatggcggtcagggaatcgactggattgaatttattacacacattgttccgtccaacatggttgatgccttcgcaaaaggggacattttgcaggtcttattcttttctattcttttcggagtgggtcttgcggcattaggcgaaaaaggaaaaagcgtcattgatttcttcgacaaggtttctcacgtttttttcaaaattatcggctacattatgcgtgccgcgccaatcggggcattcggggcgatggcgtatacaatcggacacttcgggctcgattccatcaaaccgctggcaagcttaatgatgtctgtttatattacgatgttcctgttcgtatttgttgctttaaatatcatctgcaagctttacggattcagcctgtggaattaccttcgcttcattaaggatgagcttttgatcgtgcttggcacaagctcttccgaatcggtgcttccgcgtatgatggataaaatggagcgctacggctgttccaaatccgttgtcgggcttgttattccgacgggctattcgtttaacctcgacggcacatccatttatttatcaatggcgactgtctttttggcacaggtgtttggagtagacctcagcatcggccagcaaattacgattatcctcgttctgatgctgacatcgaagggagcggcaggtgtgacgggaagcggatttatcgtccttgcctcaacgctgtcagcgctgcaggtcattccgctggaggggcttgcactcctgctcggggtcgaccgtttcatgagtgaaggaagagccattgtgaacctgatcggaaacggaatcgccacgatcattgttgccaaaagcgaaaatgaatttgatgaagcaaaaagcgtagaggctgttgaaggcatgaaaaaaatgaaaacagcagtctgaaaaaaaacggcccatccatggggccgtttttttaattgtttaagaattattaaggtaaggacagagacctcagcatttttttgttatataatttacaaatggatactatattgaatgaaggacgtttgtcctaacaggagtgtataaatggccgctttagttaaattttttcagcacccgggagtaaggcgtttctccatctttgtcgtgttaactggtgtgttatatctatttaagagcatgatcaacttaatattgcttaccttcattttcacatttctaatggatcgtttggagcttgtcgtgcggcagtttgtaagccagttcttccgcgtgagccagcgggttgtcattacgtttctttacatgttgctggctgtgctgcttacagtcgggggctttgtgttttatccggtcgtcgcggcacagatccagcagctggtaaagcagattaaacatattgcgtatcatcctgacagcatccctttctttgatgagatcaccagtgtcttcggagatattaacatcagttcatatgtcaaagagggtttcaatgtagtgtatacgtatctggccgatatcagcacattcggcttgcaggtcgtgatggcgctcattcttagcatgtttttcttatttgagaaaaaacggctttctgaattcatggcgaaatttaaaacgagcaaactgagggtcttttatgaggagattgcttttttcggaagcaaatttgcaagaacgttcggcaaggtgctcgaggctcaatttatcattgcgctcgtcaactgtattctgacgtttatcgcgctttggattatgcattttccgcagctgtttgggctttcgattatggtgttcttccttggattgatccctgtagcaggcgtcgtcatttccctgattccgctcagcattatcgcctacagcactggcggcggaatgtatgtgctctacattgtccttgtcatattcgccattcatgcgatcgaaacctatttcttaaatccgaagctgatgtcggcgaaaacagagctgccaatctttttcaccttcacagtactcattttctctgaacactttttcggcatttggggtttaattatcgggattccgatctttgtgtttctccttgatattctggatgtcaccaacaaggaagataggtctaaaggacccgagagaatagcgataaaatgtagtttaaaatcgaataatgagtgtgcctcgatctgccggcctgcctgttcaaggcatggaattaagactcggaatcggagcttggcattgcttcgcacagtggtgaacacaacaagtgacaatgcctgtcatcagtacagaaactgaaaagaacaaacagtcggagcaaaggctcatcatcggtttaaccaaacatttggaagcaacaaatgctataatacaaacagtgcctaatgttgggcactgtttattttttgtcgaaaaaggaggaaggctttatggctgagccgattttacatattgaaggcctcgataaaaagattgggtctaaacagattttaaaacagatcagcatggacgtcatggagggtgaaatcatcggccttctcggtccaaatggttccggaaaaacaacactcatccgtattatcgtcgggctgctgaaacaaaacagcggaagcgtgacaatcagcggattccagcatgatacagagtttgaaaaagcgatggaagcggttggagcgattgttgagaaccctgagttctatccgtacctgacaggctgggaaaacctcaagcactttgcgaatatgcacaaaaaaatagcggatgaacggcttgatgaagtggtggaacgtgtcgggctgacgtcagcgattcatgataaggtgaaaacctattcccttgggatgcgccagcgtctgggaatcgcccaggcaattcttcaccggccgaagcttctcattctagatgaaccgacaaacggcctcgatcctgcggggatgaaggattttcgcgatcatattaaggaactcgcagaaatggaaggaacagctgtcctgttcgccactcatttattgcgcgaggttgaagacttgtgcgaccgtgtcatcatcattcaaaaaggtgagatcaaagcggaagtcagcttacaaggaactgatcaaaccacagaaaaagcgattatagaagtgcagccgcaagaaaaagcgctcaattggctgacaggcaatcaatatcaagctgagagccaagacgggacgattgtagttgaggtggcaaaagaaaacataccggagctgaaccgatcacttgtcggacaagatctgaatgtattttccattaagccttacacgcaatcactggaagacgaatttataaaagcgacgaccgctcatcaagaggagggagaagagcttgtctaaattaatttggaatgaacatatgaaactttttaatcggaaggtcactttggtttcccttatcctgatggctgtctttcaattcttcatggctttgatcattaaacggattgtcatcagtgccggaacagatgaaaacttcatcggctatttatcgtatacaccgagcctgaacattttgctgcaggctttaacgatcgtaattgcagcaacaattgtttcgatggaatttgataaaaagacgatcaaatttttgctcattcgtccggttaaacgccaaaaggtcttttggtcaaaattaatcacagtcgtgatggtcagcttctatttgtatctggcatactacattctggcattattattcggtctcgtgttttttggcacatcggtgactgcggaatcaaagacattgctggtcaacaccttgacgctgatcgggtcaaactggcttgaagctgtaatgatgggattattcgggctgctttgttcttcgctgttccgcaacagcgcggtagcagttgttgtttcttttgtcgttttatacggagcgagtacacttgttcagctcatgaagttgtttgaaaacaagtggggcagctttttgctttttgcgaacactgactttacgcaatacagaagcggagagacagcgttgttttcaggcatgacgccattgttttcaattggaattctcatcatacatgccatattcttcatcgttgttggctggtggtgcttctgtaaacgggatgttcgggtctaaaggcaaggaatgacatttttgtgaaaaagctcacgtaaatcaatatcatttgatattttggtttatactaaaggtactgacggaggtgtctcgattgaggaactttattaccgctttaccgatcgtattgctgcttggattctcatttgtgtcattcatgtttcagtttgaacatcttgtttatttcaggctcgcgcttgggttgttttctctcgtgggactgtacatgatatataaaatgaagacgggcatccgctattttatcatctatctgtatgccagctggattgtgttggccgcagtgaccgcttttgaagagccgattttctcaagctttttctttggcggcctggtgatgacgatgggttacctgacatatatgctgatttatctcggcatgaaacaagaccgggatgcaaatcctgtgtaatcgcgctgttcccttggggaacggcgtgtttttctatactgggcaaaaggttaacagttgcggaaaaatggcaggaaatctataatacatattaaatttatcggaattaaaacttggggggctgccggatgtcattatttatacaaaacgatcaacagcggcaatggatggagaaaatcggacggattgcggatgaatttcagcaaacagctgctgaagatgacgaacagggacgttttcctgcagagaaaatacaaaaattgcgtgatgctgggtatacagcattaacattgccggcatctcatggcggagggggcatttctgtttacgatatgctcctgtttcaagaacggcttgcacggggagatgctccgacggctcttagcatcggctggcatttgagcgtgatcggggagcttggagaaggcaacagctgggatgaagacgtatttgcatttgttgccaaggaagttcaaaacggagccgtcattaacagggcggcgactgaagcgaaaaccggaagcccgacaagaggagggcgtccgggtacacacgccgtcaaaaaggatggcaaatgggcagtgaacgggagaaaaacctttacgacgatgtcacaagctctggattattttttagtaaccgcatggattgaagacaaacaaacaacaggcgtgtttctcattcataaagatgatcccggcttgtcgattgaagagacgtgggatatgatggcgatgcgggcgactgggagccatgaccttgtactgaacgaagtaatgcttgatgagaataagctggtggaactgcttcaagggcctcgtggagctaagcccaatggctggctgcttcacattcctgcgatttatcttggtgtggctcaagctgctcgtgactatgcagtgcaatttgcatctgagtattctccaaacagcttgaatggaccgatcaagaatgtcccggccgtacagcaaagaacaggcgaaatggagcttgaactgctcaatgccagacactttcttttccatatcgctcaattgtatgacgatccggagcggcgtccacacttgaccagcgagctcggtgcggcgaaacatatcgtcacaaacgctgcgctgtctgttgttgataaagcgatgagaattgtcggggccaaaagcctggaacgaaccaacccgcttcagcgctattaccgtgatgtgcgcgccggtcttcacaacccgccgatggatgacgccgtgatacacaagctggcggctgaagcgtttgagtcataaaaaaagagcctagccggctctttttatgtattgttttgctcttgcagatttttttgatgcttgcggtcaattctgtcataaataacgttcatcagctttggattgcccataatcgcctctttgttttcctggatcagctgttggtaagttttcactttacgcttcggcatgctccggcgccctcctgacatgtttgtattcactttctaactccgtcagcgacaattcatacagatgacgctttgactttttgtatataccattctgtattaacagatgaatgagctgtttttttctgatttctgcagactgaggtgtcattgtgtcaccaacctccaatcaaacgatattgataatcattatcaattaacttcagtatacaatgtccgcaatagcctgtaaagatgaaaagagtcctattcttggccaatttacaaacattcaacaaatcgacaaaaagtttcccgggcaataatttgctgtcgaaatattccgcttcattgaacgcgtcctgctatttttcatgttttgaaccatactatgtaatagaatggaggctggtattcaatggagcggacagaaaatctgaaaaagggagaaaaaggggcgctcctcaatatttttgcatatgtcatccttgctgttgtaaagctagttatcgggattctatatcattctgaagcgctgagagcagacgggttaaataatggaacagatattgttgcgtcagtagcagtgctgataggattgcggatttctcaaagaccggctgacagcgatcatccatacggccattatcgggctgaaacaatttcgtctcttgttgcgtcttttattatgatggcagtcggcattgaagtgttaatcggcggaggaaaagcgattgcgggcggcacaacggaaacgccaaatcttatcgcggcatggacggcgttaggcagtgctgtgtttatgtatggcatctatttatataacaaaaggctggcagcgtccattaaaagctctgccctgatggcagcggcaaaggacagcaggtcagacgcttttgtaagtgccggcgcgtttatcggtgttttttcgtcccagctgaagctgccgtggattgatccggtaacggcttttatcatcggcatcatcatttgcaaaactgcgtgggatatctttaaagacgcttcacattccttaacagacggcttccatttaaaagatcttgagccttacaaacagaccgtcggcaggatcgaaaatgtgcatcgcctaaaggatgtgaaagcgaggtatttaggcagtacagttcatatcgagatggtgattacggttgatccgaagcttacagtagaagaaggccatggagtggcggatgaagtagaagacaaaataaaacatgaacacgatgtcactcatgttcatgttcatgtagagcctgacgacataaaataaggctgtttaacgaattagcttatatgttcagataaaaattcagtcacttcttcaggcgttttggcattggcgctgtgaaggtgagctgttttttcaccgttcttgaaaataagcaggctgggaatgcccattacttggtatttttcagccaggtcaggaagctcgtccttattcagctcataccagtcgttttggttgtattcttccaaaatatcgccgatgaacatattcatgcgtgtgcagtctgggcaccaatcagcataaaactttacaatgatttctttatcagattgaatcagttcattaaattgttcgtttgttgtgatttttttcatatgtcacatctccttttcaatgccattttaatataaaataaaaaggaattacatacaaatgcattcaacatcagcatgcccaaaaataattagatcattttccggtgaaaatgataagatagtaaagatgaattgtagtggggggagtatccattgaaaacaagtctaggattagtgtacggaggaaagtcggcagaacataatgtttccctgcagacagctctggctgtaatcaaagcgctaaatactgagaagtttgatatacatccgatttatataacagaaaaaggcgaatgggttagaggcgcccgtttaactgaacctgtttcaaacgtgaaaatgcttcaatttgagcaaggaggcagtgctttttctccagctgccctgaaccaggagatgtttccgcaggaagcgtcacagcaaaatgaagccatcgacgtcgtattcccgctcctccacggaccgaacggagaagacggtacgatccagggaatgctcgagctgttgaacattccttatgtcggcaacggagtgcttgcttcctcagccggcatggataaagttgtaatgaaacatttatttgctcaggccggccttgctcaggctaaatacgcagctttccttaagaaagactggactcgttctccgaaagaaagctgtgagcaggttgaacaggaattaggctacccttgcttcgtaaaaccggcgaacctcggctcaagtgtcggaatcagcaaatgccgaaaccgtgaagaactgcaaaaagcgtttgagcttgctttccaatatgatcgcaaagtcgtcgttgaagaaggaattaacggccgcgagattgagatcggcgttcttggaaatgatgatcctaaatgctctgttgtgggagaaatcgcaccgaagacagatttctacgattacaaagcgaaatatgaggatggagatactgatctgatgattccggcgattgtgtctgatgaggaatacgcaacaatcagtgatatggcgatcaaagcgtttaaagccatcgacggttcaggactcgtcagagcggactttttcctgacagctgacggcgaagttctgatcaatgaagtcaacacaatgcctggctttacgcctttcagcatgttcccgctgctctggaaagaagccggagtggaatatgctgagctgattgaacagcttgtggagcttgcaaaagaacgccacgctgaaaaacaattgattaagcatacattctaatgaagaaggacactgccggtaaagggcagtgttttttcccgtatatacaaagaaagagagggaccttacttgattaagcgaacagtaaaaaacattgccgaaatggttaatggcacactaacaaatccgcaatatgaacaaacagtcattcatggagtggcaaccgatacaagaaaactggaacaacatcagctcttcattccgctgaaaggggaacgttttgacggccactcttttgtggagcaggcttttgaagctggtgtagcggctgttctttgggatcggtcagtaccaaatccgcccgagaatcacgccgtcattttagtggatgatacccttactgcacttcagcagcttgcaaaagcctatttgcaggagcttggcacgcgtgtcatcggagtaaccggaagcaatggcaaaacgacaacaaaagatatgattcacgccgtactggggaccaagtaccgtgtccacaaaactggaggaaacttcaataatcacatcggtctgccgcttacggttttagcgatgcctgaaaatacggagatcgccgtattggagatgggaatgagcgccaaaggagaaattgacctcttgagccgactggcaaacccggatgcggcagtgattacgaatatcggcgaatcgcatatgcaagacctcggctctagagagggcatcgcggaggcgaagcttgaaatcataaacgggcttaaagaagacggagtgctaatttatatcggggacgaaccgcttcttcaaaatgcatacagctgccagacgaaaacgtacggtacgggaacgcataatgattatcagcttcaggatgtcagccagagtgaggaaggaacccattttacaatcaaagggatagaaaaaacgttttttattccgatactcggcaagcacaatgtgatgaacgccatggctgcaattgctgcaggggcttattttggcatcgcgcctgaggatgcggcaaaaggactgagcggcctaaaggtaaccggtatgaggcttgaactcatcaaaacagacagcggcctttcgataatcaatgacgcttataatgcgagcccgacttccatgaaagctgcaattcaattgacagaaagccttgaaggctacggcaaaaaaatgctcgtgctcggtgatatgcttgaactcggcgatcttgaagaaacgttccataaagagtgcggcgctgtgatcagccctgagaaaattgaccgcgtctttacgtacggaaaactgggagcttttatcgcggaaggcgccctgaaacactttgagaaagaccgcgtcagccattacactgagaaaaaagatctactccaagctgtgaagaaaaacgcatcaaaaggcgatttgattttattcaaagcgtccagaggtatgaagcttgaagaaatcgttaaagatttaatagagagcccgctttcataagaaaatattttgcgaaaaaacgcatattgcatcataaaataacatgatatgcaaacactaatgtatgccggccgaaaattatgtatatctggccggctgcggctatgatacaatatatataggttatttcgcgatacgaacatattcgtccggacttttcatcgtgacccgaagttctccgctggattcttgggagcggatggagcagcagccggcatattcgagatgccgatctgcttctcatcttattgaaaaacaaatagtgtaatggtaagataaaacttaaagtaattcgggctttgtatacggatggatcctgtccttcttgtctaaagggcagttttataagtggtaaatcacgacattactgaaacagcaattagaaggagtttgaataatttgactataacgtttcaagattttaatttaagttctgatctcatgaaagcaattaatcgtatgggatttgaagaagcaacaccgattcaggcacaaacgataccgctcggactttcaaataaagacgtcattggacaagcgcaaacaggtacaggtaaaacagctgcgtttggtataccccttgttgaaaaaattaaccccgagtctcctaatattcaagcaatcgtaatcgcgccaacccgtgaattagccattcaagtatctgaagaattgtataaaatcggacaagataaacgtgcgaaggttcttcctatttacggcggacaggatattggacggcaaatccgggcgttaaagaagaatccgaatatcattgtcggaacacctggacgtcttcttgaccacatcaaccgccgcaccattcgtttaaacaatgtaaataccgttgtaatggatgaagcggatgaaatgctgaacatgggattcattgatgatattgaatctatcctttcaaacgtgccaagcgagcatcagacacttctgttctctgccacaatgcctgcgccgatcaaacgcattgcagagcgctttatgactgagccggaacacgtaaaagtaaaagcgaaagaaatgacggtttctaacattcagcagttctatttggaagtgcaagaacgcaaaaaattcgatacactgactcgccttcttgatattcagtctcctgagcttgcgatcgtattcggacgtacaaaacgccgtgtcgatgagctggctgaagccctgaatcttcgcggatatgcagctgaaggaattcacggtgacttaacgcaggcgaaacgtatggtagcgcttcgtaaatttaaagaaggcgcaatcgaagttctagtcgcaactgatgttgccgctcgcggacttgatatctcaggtgttacacacgtatacaacttcgacgtgcctcaagatcctgaaagctacgttcaccgtatcggaagaacgggccgtgcaggaaaaacaggtatggcgatgacgttcattacaccgcgtgagaaaagcatgcttcgcgcaattgaacaaacaacaaaacgcaaaatggaccgcatgaaggagcctacacttgatgaagcgttagaaggccagcaacaggttactgttgaacgtcttcgcacaacaatcagtgaaaacaacctgaacttctacatgacagcggcagctgagctgcttgaagatcatgatgcagtaacagtggttgcggcggctatcaaaatggctacaaaagagccagacgacacaccggttcgcttaacagacgaagcgccgatggtcagcaaacgctacaaaaaccagcgctcttctaaacgcagagacggtcaaggcggcggctaccgcggcggaaaagggaaaagcaacaaccgttcttcctatgacaaaaagcgttcaaacgatcgccgttcttcaggtgacagacgccagaaaaaatcttactaatttgatcgattcagagcccaaaacatgatgttttgggcttttttatgttcgcgatttgttattcagcaaactttcagctgacggaagccatttttctctgtatgcttaagaatgaaacctttctgtaaaagagacgtataaataacgacgaaaaaaagggaggtaggtatttttgagagagcagccaaaaaaccaaatcagtccagacggattaaaggtttggcgacttcaagagatcatcatatccgctgtttgcttgcttattgtcattgcagttgcagtgttaagctattattttcattggccgtactggatcagcggcgtgctcggcgctgtttggctgctgggatcgattgtgacggtctttatcattccgaaggtccgtcataaggtgtggcgatatgaagtccatgaacatgaaatagatattcagtcaggtatttttgtggtgacacgtgtgattgttccgatggtcagagttcagcacgtcgatacgtcacaagggccattattaaaaaaatacaacctggcaacggtgaaaatttccacggccgcgaccgttcattcgatccccgctttagagatggaggaagcggatcggctgagagactccatttcccgtctggcaagggtgactgacgatgatgtctgaaccgaaacgcctgcacccggcagcagtcattttgaatttatgccataccattattcaaacgataaaaaatatcattctgccattcttttttgtgtatattgtcaattcaaaccatactgtccgattttacggggctattgcgctcggtgtgctgttcatctggcttgtagcggcaagcattatcaaatggagaaggttcacctatcgaattgaagatgatgaatttagaatcgaagaaggcttatttgttacgaaaaagcgatacatatcgattgatcggattcaaacgatgaatacgagcgcaggccttgtccagcaaatctttaagcttgtgaagctgcaaattgaaacagcaggaggaggcaaagaggcagaagccgtcctttctgctatttctgttgaagaagcggaacgcatcaaagaagctgtctttaagaaaaaagcgcaaagacgagaaaatgaacttgatgaagaacggcttgaagctgaagaggagttggatccgtccgttgaggtgcaagagcactatcgcatgaacgcgaaagaattgctcatggccgcttctacctccggcggaatcggagtcattatctccgctgtatttgcacttatttcccagcttgatgaagtgctgccgatggattggttattcgataaattttccttccttcagcacgccagcatcggtatttatgcggtactcatttttatcggtttatttatcgcctggattttcagcatcgcgggcatgatgtttagatacgcgaactttcaaatcataaaaaaagagcaggaactggtgatttcaaggggaattattgaaaaacatcaagtcacgattccgctgcgaaaaatacaagccattaaaatcaaagaaaatatcattcgccagcttttcggctttgtaacggtgtccatcgtcagcgcaggaggcggcgaccgggaaaaagaagaaggtgctttgaccattctctttccaatgattcataaaaaaaagcttccgcacatgctccgaacatttacaccggaatatacgctggaagaaaactgccgccgcctgccgcggcgcgcgttgaaacgctatttgttccgttctgtcattttttcactctttttgatcatcccgttatgtatcttctttcagccatggggctatctgtcagtgatcctgctgccgatagaattgctcttcggctatctcgcgtataaagaggctgcatggacgatcaacggggaccgtcttcagctgacgtctagatttataggcagaacaaccgccattgtactgaaaaaacgaatgcaggtctgcaagttcagccaatcctatttccaaaagaaaggccgcttgtataccatttctacttcggtgaaatcatcgagccatatggaagaattaacggtgagggatgtaggtgaagaggatgcagccttcattttaaagtggtactcatatgaaaaagcggacggttaataccgccgctccagcgtgtcggcaaaccctcgcattcgttgtcaggactgcgcttcggtgctcacgaattagaacattcgctccgctcctatgctcgtccttcctagacttcaagggttttcaatcacgctgaaaagatgacaaaatcctaaaatgaaaaccattttaggattttgtcaacaatctgaagcggcggttaataccgccgctcttttttttgcacgcataaaaacgaaagaagaaacccgccgcatagtccaaacaaatgggccatcatgttaatattggagttgataaacgacatgagaatggcgaatgcgagcagtgtgatgatcattttggaatgctcctgcccaattaactcattgcgaaaaagaaccataaacaggtatacgccaaatagcccgaaaatggcgcctgaagccccgacatgcacgtaatcaagcggctctgtaacataagtgccaatattgccgatgatgccggagccggcgtatacaagaaggaaacgcgcttttcccagcatgcgttccaaagccggggcaaataaaaagatggacatggaattaaacagcagatgtgtgaaaccggcgtgcagcaaaatcggtgtgataagccgccaccattcaccgtttgcgacacctagattatagcctgtgacggtatccctccataacacgactgaatgggcaggaagtgaaaaaaacagccagagaacagcttgcaaagccaatataaaggtgacaacggggtaaagcctgataaatgtttgaaaattttcagtccgtataaacattctgagccccttttcttcattttggtatatctatagtaacacgtttatgagacaaaccatttaaatagtacgtacgcaaaggaggttatcatacatgatttacggcattgggctggacattaccgagcttaaacggatcgcctctatggctgggcgccagaaaaggtttgccgagcggattttgacgcgaagcgagcttgaccaatactatgagctttcagagaaaagaaaaatcgaatttctcgcgggcagattcgcggcaaaagaagctttctcgaaagcatttggcaccggcattgggagacagctcagctttcaggacattgaaattaggaaagaccaaaatggcaagccctatatcatttgcacgaaactgagccaggctgcagttcacgtatcaatcactcatacaaaagaatacgctgccgcgcaggttgtgattgaaaggttgtcaagctagtctgcatattagggaaaccccactcatatatttgatagtgcattaagggagacaagttgtttgaggcttttatggtacgcatctgttctgcctaaacgtgtaccgagcgtaccgttaaagtcaaacaagcgatttcttccttttacatcaattgagaaaaagggttgaaaaaggtgagaaaaagctttgttttgcttttaacgggactgcttgctgttcttattctttctgcctgcgggcaaaaaacacagcaagatattgtggccgggttagatgaaaaggcgaaagaatacacctcgtacaaagcaaaagcgaaaatgaccatcgagacagggagtgagcctcaagtatacaatgtggaaatctggcacaaaaagccgtctctgtacagggtttatttagaaaatccgaaaaaggaccaaaaccaagtcattttacgaaatgaaaacggagtattcgttcttacgccgtctttaaataagagcttcagatttcaaagcgattggccgaacaacagcagccaggtttatctgtttgaatcgctcgtaaaggatgttcaaaacgattcggatgcagttttcacagcgaaagaaaagaaatacgtattcgaaacaaaaacaaactatcagcataacaaaatgctgcccacgcaagaaatcacatttaacaaaaaagatatgagcccgtcatctgtcaaagtgatggatactgaccggaaagtgatggtcaaagtagaattcagcagctttgaatttaataaacaatttgataaagaatcatttgatgaaaagaaaaatatgaccctttctcaaatggatgtcgccacaagcgcgaagccttccgatacatttgcggtcaaaacgccgctggaactgccgcttggcgtcaagctgcttgaagaaaaagatatatctactgaagacgggaagcgcatcatcatgacgtacggaggagaaaaatcatttacgttaattcaggaaaaagcccagattgccaaggcttcctcctccgttacgctgaacggcgaaccggtaaatctcggctacaccatcggcgccctgtcggatgcatcattatcatggacatatgacggcgtagattaccttctctcttctaaagatctttctaaagaggaaatggtgacagtagcgaaaagcatgcagggacaatcatcgaaataaccgccaaaggccaaacatgatttggcctttttttcgttagacatcgtttccctttagcctttaattttagtatgatatgtaaatgatattgaataaaagctaggaagtgtcgtaatgagcacaaaacctttttacagagatacgtgggcggaaattgacttgtccgcgataaaggaaaatgtcagcaatatgaaaaaacatatcggtgaacatgtccacctgatggcagttgtgaaagcaaacgcctacgggcatggtgatgcagaaacagcaaaggctgctcttgacgcaggtgcttcatgcttggccgtggccattttggatgaagcgatttcactgcgcaaaaagggattgaaggcgcctatattggtgcttggcgcggttcccccggagtatgttgcaatcgctgctgagtatgacgtgaccttaacaggttattctgttgaatggcttcaggaggcagcccgccacacgaaaaaaggttctcttcattttcatctgaaggtcgatacggggatgaacagacttggtgtaaaaacagaggaagaagttcagaacgtgatggccattcttgaccgcaaccctcgtttaaagtgcaaaggggtatttacccattttgcgacagcggatgaaaaagaaagaggctatttcttaatgcagtttgagcgttttaaagagctgattgctccgctgccgttaaagaatctgatggtccactgcgcgaacagcgccgccggactccggctgaaaaaaggcttttttaatgcagtcagattcggcatcggcatgtatggccttcgcccgtctgctgacatttcggacgagataccgtttcagctgcgtccggcatttaccctgcattcgacgctgtcacatgtcaaactgatcagaaaaggcgagagcgtcagctacggagccgagtacacagcggaaaaagacacatggatcgggacggtgcctgtaggctatgcggacggctggctccgaaaattgaaagggactgacatccttgtgaagggaaaacgcttgaaaattgccggccgaatttgcatggaccaatttatggtggagctggatcaggaatatccgccgggcacaaaagtcacattaataggccggcagggggatgaatatatttccatggatgagattgcaggaaggctcgaaaccattaactatgaggtggcctgtacaataagttcccgtgttccccgtatgtttttggaaaatgggagtataatggaagtaagaaatcctttattgcaggtaaatacaagcaattaacttacctaaatggagaattcataaaacagctttgcttgaagagtgaataatggtatcattatcactggatggataaaagagtcgtatccgtaagtttggtggaggtgtatgttttttgtctgaatccagcgcaagaaccgaaatgaaaatcagcttgcccgaaaacctagtagctgaattggatggtgtagcgatgcgggagaaacgaagcagaaacgaactgatatcacaagcagtgagagcgtatgtcagcgaacgaacaactcgtcacaaccgtgatttgatgagacgcggctatatggaaatggcgaaaatcaacctgaatatttcttctgaggctcactttgcggagtgcgaggctgaaacgacagttgagcgcttagtcagcggaggataatcatttgattgtgaaacgcggcgatgtttattttgctgatttatctcctgttgttggctcagagcaaggcggggtgcgcccggttttagtgatccaaaatgacatcggaaatcgcttcagcccaactgctattgttgcagccataacagcacaaatacagaaagcgaaattaccaacccacgtcgaaatcgatgcaaaacgctacggttttgaaagagattccgttattttgctggagcaaattcggacgattgacaagcaaaggttaacggataagattactcatctggatgatgaaatgatggataaggttgatgaagccttacaaatcagtttggcactcattgatttttagacatatttgcaggttgctcaaatagagcaactttttttgttttcaaaaaacataaacgatataatagtgaaataacgaaaaaaatatgttgttttttattgggaggtaagcgaattagatgtcgaatcagactgtataccagttcattgccgaaaatcaaaatgaactgctccaattgtggactgacacactaaaagaattaagcgagcaagaatcctatcagctgactgaccaagtgtatgaaaatatatctaaagaatatatcgacattctgctgctgtctgttaaggacgaaaatgctgctgaaagccaaatcagcgaactggcgcttcgagcggtccaaatcggactgtctatgaagtttttggctactgcgcttgctgaattctggaagcgtctctacacgaaaatgaatgataagagattgccagatcaagagagcacggaattaatctggcagattgaccgctttttcagcccgattaacacagaaatttttaatcaatactcaatctcatgggaaaaaacagtatccctgcaaaaaatcgcgctgcaagagctgtctgcgccgcttatcccggtgtttgaaaatatcactgtgatgcctcttgtcggaacaattgataccgaacgcgcgaaacgaattatggaaaaccttcttaatggcgtcgtcaaacaccgttcccaagtcgtgctgattgacattacaggtgtccctgtcgtcgatacgatggttgcccatcatattattcaggcatcagaagctgtaaggcttgtcggagcaaaatgcctgctggccggaatccgtccggaaattgctcaaacaatcgtcaacctagggattgatttatcccaagttataactaagaataccctgcaaaaaggaattcaaacagcattggaaatgacggatcgaaaaatcgtttcattgggggaataacattttgagacatccgaaaatcccgatcttgaaactgtataattgcttattagtatccattcaatgggaacttgatgaccagacagcattaacttttcaagaagacttattaaataaaatatacgaaacaggtgctaacggagtcgtcattgacctgacatctgtggatatgattgattcatttatcgcgaaagtgctgggcgacgtcattacaatgtctaagttaatgggggctaaagtcgtcttgaccggcattcagcccgctgtggcagtgacgctgattgaacttggaatcgcgcttgaggaaatcgaaactgcgctcgacttagagcaggggcttgagacattgaagcgggaattgggggaatagcgaatgaacgaccaatcctgtgtaaaaatcatgacagaatgggatattgtggccgccagacagctgggacgaaacgttgcgaaagaactgggtttcggcacggtagaccaggctagaattacaacggctatttcagaattagccaggaatatttatttatatgccggcaaagggcagattggaattgaacaggtcgcagacagaggaaaaaaaggcctgaaaatcatagcggaagaccaagggccgggaattcctgatatccgaaaagtcatggaagacgggttttcaacgtctggaggacttggtgcgggacttcccggggtcaaaaggctgatggatgaattcagcttaaattccgtagcgggggaaggaacagagatacaagccatcaaatggcttcggtaggaggtaagaacgtggattttagggaggttattgagcagcggtatcgtcagctgcttagccgatatatagccgaattaacagaaacatctttatatcaagcccaaaaattcagccgaaaaacaatcgagcaccaaattcctccggaagaaatcatcagcattcacagaaaagtgctgaaggagctgtatccaagtctcccggaagatgtgtttcattcgctggattttttaatagaagtcatgattggttatggaatggcttatcaggagcatcaaacccttagagggatacagcaggaaatcaaatcagaaattgaaatcgcggcaaatgtccagcagacgctgctcggaactaaagttccccaggaggaagcgctggatatcggcgccatcagtgttcccgctaaacagatgagcggtgattactaccactttgtcaaagacaaggaatccatcaatatcgcaatcgcggacgtgatcggaaaaggcattccagcggctttatgcatgtccatgattaaatacgcgatggactctttgccggaaacgggcatacacccttctcaagtgctgaaaaatttgaatcgtgttgttgaacaaaacgttgatgccagtatgtttattacgatgttttatgcgaattacaatatggacaatcatcaatttacatatgcttcagcgggacatgaaccgggattctattattctcaaaaggacaacacgttttacgatttagaggccaaaggactcgttctcggcatctcacaggactatgactacaaacaattcgatcagcatctggaaaagggcgatatgattgttttattttctgatggcgtcacagaatgcagaacggaaaacggtttcttggagcgtcctgatctgcagaagctcattgaggaacatatgtgttcctccgcgcaggaaatggtcaaaaacatttatgacagcctcctcaaattgcaggattttcagcttcacgatgattttacgttaattgttttgcggagaaaggtttaacgtctgccagacgagggtataaagcaactagtgattagtgatttgaaggaaaatttgaggtgatacgaatgaatataaatgttgatgtgaagcaaaacgagaatgatatacaagtaaacattgcaggagaaattgatgtatactcagccccggtgctcagagagaagctcgttcctctggcagaacaaggagctgacttaagaatttgcctgaaagatgtcagctacatggacagtaccggattgggcgtttttgtagggacctttaaaatggtgaaaaaacaaggcgggtcgctgaaacttgaaaatctttctgaccggctgatccgactgtttgacattacaggcttgaaggacatcattgatatttctgcaaagtcagaaggtggagtgcaatgaagaataatgttgattacatcgaaatgaaagtgccggcccaacctgaatatgttggaattataagactgacgctatcaggggtcgcaagcagaatgggctatacgtacgatgaaattgaagatttgaaaatcgcagtcagtgaagcgtgcacaaatgcggttcagcacgcttacaaagaagataaaactggggaagtgtcaatacgattcggtgtgtttgaagaccgtttagagattattgtggcggatgaaggagacagctttgactttgatcaaaagcagcaggatctagggccgtacacaccttcgcacacagttgatcaattatcagaaggagggctcggtctatatttaatggaaacgctcatggatgaagtcagagtgcaaaaccactccggcgtcaccgtagcgatgacaaagtatttaaatggggagcgagttgatcatgacacaaccatcaaaaactacgaaactaactaaagatgaagtcgatcggctcataagcgattaccaaacaaagcaagatgaacaggcgcaggaaacgcttgtgcgggtgtatacaaatctggttgacatgcttgcgaaaaaatattcaaaaggcaaaagtttccacgaggatctccgccaggtcggcatgatcgggctgctaggcgcgattaagcgatacgatcctgttgtcggcaaatcgtttgaagcttttgcaattccgacaatcatcggtgaaattaaacgtttcctcagagataaaacatggagcgttcatgtgccgagacgaattaaagaactgggtccaagaatcaaaatggcggttgatcagctgaccactgaaacacaaagatcgccgaaagtagaagagattgccgaattcctcgatgtttctgaagaagaggttcttgaaacgatggaaatgggcaaaagctaccaagccttatccgttgaccacagcattgaagcggattcggacggaagcaccgtcacgattcttgatatcgtcggatcacaggaggacggatatgagcgggtcaaccagcaattgatgctgcaaagcgtgcttcatgtcctttcagatcgtgaaaaacaaatcatagaccttacgtatattcaaaacaaaagccaaaaagaaactggggacattctcggtatatctcaaatgcacgtctcgcgcttgcagcgcaaagctgtaaagaagctcagagaggccttgattgaagatccctcgatggagttaatgtaatgatccaggttgaagaaaatgagcatattcaaactctagtatatcaactgaataaagaagggaaatcgatttgcggtgacagcttttttatgaaagctgatgataaggagttaatttgcgcggttgctgacggactgggaagcggatcacttgctaacgaatcctctgcagccatcaaagacttagtggaaaactatgcgagtgaagacgtagaaacaattatcgaacgctgtaatcaggcgatgaaaaacaaaagaggcgctacagcatctatcctgaaaatcaattttgagcaaaggcagtttacgtactgctctgtcggaaatgtacggtttattctgcattccccgtctggtgaaagcttttatcctctgccgatttcgggctatttatcaggcaagccgcaaaaatacaaaacgcacaccgccacctatgaaaagggttcaaagttcattatacatacagatggactcaacgtacctgatatccgctcccatttaaaaaaggccaatcggtagaagaaatatcgaattcgctgaagatgtatacgacatcgagaaaagatgacctgacctatattctcggacagctgtcctaggaaacctgaaaaagaagctggacatccggcttctttttttgcggttgactattagtaagttcacttattataattaataagtgaacttatcatttagggggcttatgggatgtggaattatgaatacactgcggtagctgatgcgaatatagaaaaaatctggagccgttatcaggaaacagaaacatgggatcaatgggatgcgggtattgcatcagcatctttgaagggaccgtttcaaaagggaacggaaggaacattgcttctgcaaggacatacagttcctttttgacttgagcatgtggagaaacatcggtcattttctgtcatggccaacatgccgcataacaatgtaaaaatggagttttctcacgtgcttcaaaagcaaaaagaagatttgcgtatcacatatggaattgtattagaaggcgctgaagcaaaaaagtggggagaaatcattgggactgaactgtctaaagacatgccgacggctgtcagcaggcttgtccatctttacggaggagtgataaaatgaacacaaattactggatcggcgttgtgtcagagcagcatgtattaaaaggcgctgccggcggttttgcacagctgtgccatggaaaaaaagccccgctcgccaaaatgaaagagggagattggctgatttattattctccgagagacgcatatccagacggcaaactgctgcgaagctttactgcgatcggcaaagtaaaaagcggaaacatctatccgtatcaaatggctccgaattttattccataccgattagatatagactattatccatgccataaaatcggtttttacgacattaaatcaaagcttgaatttgttcaggaaaccaagcatcttggctttttatttcgcagtggacactttgaaataagcaaaaaagattttttgacaatagcacaagcgatgggagttaacataagtggaatggcactctaaatttagcggtccgaacacaagcccgggctttttattatggcaggccacgcaaagctggcagcggaaagtgggaaaagcattggctgagtttgacctgacccacgttcaatttgttctgctgacctcgtgcaagtatatgattgctcacggagaaaccgtcacgcaaaaaaaacttgcaagctttagccagaccaatatcatgatggtttcggaggttgtgcggacgcttgagaaaaaaggatttatcgaaagaagcaaaaatccccaagataaaagagaggttctcctgtctcttacagaaacaggaggagaaaaagtaacagcggctttgccaattgttgagaagattgatcaagccttctttgcagctgcgatgaaaaaagagaattttctgagcggattacaggaactattgaaacatgagtaaagagacgggcagcgtcagctgtctttttttatgtgtttttttcggtttttgatacactagagacagaacgacaaaattggaggctttggttacatggaaacgtcagcccttttaaaacagcaaattgcgaaagaaataggtttatcacaaaaacacgttgaaagtgtcatccgcctgcttgaggacggcaatacagtcccgtttattgcccggtatcgaaaagagcagacgggttcaatggatgaggttcagattcagacgatttctgaacgctggcaatacatacaaaacctgaatcagcgaaaagaagaagtcatcaggctgattgcagagcaggataaactgacagatgatctaaaaggtaaaatcgagcaatcggtgaagcttcaggaagtggaagacctttaccgcccttataaacaaaaacgcaaaacaaaggcgacagttgccaaaagcaaaggtcttgagccgcttgccgactatatcctgacacttccccaagatgatcgtctggcagcaactgcagaccaatacatcagcgaagaaaaagaagtgttcacacgagaagaagcgattgaaggcgccaagcacattattgcggaacaaatctcagacgagccgactttcagaaagtggattcgccaggaaaccttcaaaagaggaaccattaagtccgcagccggaaagtcggcagacaccgatgagaaaaatgtgtatgaaatgtattacgagtatgaagagccaattgcaaaagtcgttccgcatagggtactggcaatgaaccgcggcgaaaaagaagatattttaaaggtgtcaatcgaaccgcctgcggatcacattaaggcgtatttagaaaaacaaatcattaaaaatcgctcaacatccgtaaaagagattttgcaggagacaattgaagacagctataaaaggctgatccagccggcaatcgagcgtgaaatcaggaaagagctctcagaaaaagctgatgaacaggcgattcatattttctcagagaacttgagaaaacttcttttgcagccgccgatgaaaggcaaaaccgttctcggtgttgacccagcctttcgaaccggctgtaagctcgctgtgtcagatgagactggaaaagtcttgaaaattgatgtgatctatccgcatgcgccagtcaacaaaacaaaagaagcccatgaaaaagtgaaaaagattcttgagcagtatcaagtcgagatggtggcgatcggaaacggcacagcatccagagaaacagaacaattcatcgtcaatgtactgaaagacatgccgcgcaaaatttattatgtgatcgtcaatgaagcgggtgcaagcgtctattcggcttcagagctggcccgagaagaattccctgaccttaaggttgaagagcgcagtgccgtgtctattgcgcgaagacttcaagacccgcttgcggagctcgttaaaatcgatccgaagtctgttggtgtcggacagtatcagcatgacgtcagccaaaaacgcttaaatgaatctctgcggtttgtagtcgaaacggtcgtaaaccaggtgggagtaaacgtcaacacagcctccgccgcgctgcttcagtatgtagcgggattatcgaagtctgtagcaggcaacgttgtcaaaaaacgtgaggaaatcggaaagttttcaaatcgaaaagaactgaaggacatcccaaggctcggtgcgaaaacctatgagcaatgtatcggtttcttaagagtgcaggaagggacagagcctttggatagaacaggcattcacccggaaagctataaagaaacaaaagcgcttttgaaaaaacttggactttcaacagaacatatcggcacggcggaattgaaggacaaaatcaatcagctggcgctttctgaaacggcaaaagagctgggaatcggcgaaatcactctgaaagacatttgtgaacagctgacaaggccggaacgcgatccgcgcgatgaggtgcctaagcctttgctgaaaacagacgtccttcagctggaagatttgaaagagggaatggaactgcagggcaccgtgcgcaatgtagtggacttcggagcgtttgttgatatcggagtcaaacaagacgggcttgtgcatatctcaaaattgagcaatcaattcgtcaagcatcctcttgatgtcgtatctgtcggcgatattgtgacagtttgggttgacggcgtagatgtacaaaaaggcagagtatcgctgtctatggtaaaataaaagcactgcttacgagcagtgttttttcctatagaaataccagcattgattcagcagtttaatttggtaattatctttttcaaggaacgctttttgcatctgctttttaagccaatttggcataggctcattcctcctcagcttttatcataagagggacggtgattaccatattgtatgcgaacggtgaattgtcccgttcaatgttttttaagtgaggtgcactatggataatatagagcttcaaaagctgacagaggatatttctaaaacatattttaaaaagccgttccgccatcaggcgctttttaatgacaggcttaaaaccacgggcggaaggtacctgttaacctctcataacattgaattgaacagaaaatatctgattgaacacggcagggaggagctgatcggcatcatcaagcacgagctctgccattatcatctccaccttgaaggaaaagggtacaagcacagagacagagattttagaatgctattgcagcaggtcaacgcgccgaggttctgtacaccccttaagaaaaaagcggaaaacaaaaaaacttatatgtatatctgtacggcctgcggccaacagtatataaagaagcgcgccatgaaccctgacagatacagatgcggaaaatgccgcggaaaaataaaaagaattttttcgtgaaaaaggttgacgaatatggcaagcgtatgttacattataaaagtcgtcacgagagataaataaaaacatttacctcttgacactgcaaatcaaggctgatataataagtcttgtctcattattccacagtagctcagtggtagagctatcggctgttaaccgatcggtcgcaggttcgaatcctgcctgtggagccatattggagaagtactcaagtggctgaagaggcgcccctgctaagggtgtaggtcgcgtaagcggcgcgagggttcaaatccctccttctccgccataagatttcgatataagttctcaaccatcggcccgttggtcaagcggttaagacaccgccctttcacggcggtaacacgggttcgaatcccgtacgggtcattccatttcgttgggctatagccaagcggtaaggcaacggactttgactccgtcatgcgttggttcgaatccagctagcccagccatttttatttttgaaatctaatagtaagagccattagctcagttggtagagcatctgacttttaatcagagggtcgaaggttcgagtccttcatggctcaccatttgtatttttgcgggtgtggcggaattggcagacgcgctagacttaggatctagtgtcttacgacgtgggggttcgagtcccttcacccgcactttatttacaaagtgcacgcaaatcggttttactaggttaagagcctactaaaccagcacaaacacaatttaatgatcacgcggtcgtggcggaatggcagacgcgctaggttgagggcctagtgggtgaataacccgtggaggttcaagtcctctcggccgcatcccaataataccaagggtttaaccacctttggtattatttttttgtgcggaaatacggctatgagagaagagttgctcatcaaaactcaccagttacttaaagtaatcatccaaacggtcggcagttccttctgtttattaggaaaaagatatccgttcattgtaaaagaaacgaaccatgtcctattcgttcaaaaaaactaatgggtgatacatattatacatgattaatatgtatcacccttttctttcttgttcaacaattgcgcttgaggagaacataagctaatacaactgactcgatttctaaagttgctccattcttttttttaaaaactcatccacaacctgttttaaaatctcgtacgactgaatttccttgctcaattcgtaaatattagataacacaattaattcatctgcgtgatacatttgttggaaatcaattagttcgcgacgaattgtttctcgatcacccatgattgtataccccagtcgactgtggagaatttctaattcaaactgtgataacgattctaggaagttttcagtgggtggaataagcttacttaaattatttgtataaatatcaatatacacctgcaaatgacttgcagaaataaaagattcctcgtctatagattctgctgcaatcacattaatgcaagcgatcacataaggttcttgtaaataagaagacggttggaaattttctcgataaatagagagcgcttcttccatcgaatgggggaaaattgagcgccaaatgcatagggtaaaccaagctttgcagcaatttccgctgaatccgttgaggatcctaacacaaaaacaggcacatgcgttccaatacccggataagcgcgaacctcaccctgtacactcttatccccgacaaaacgcaaaatatcatttacttctctttcaaagaaaaacactccattatggttggaacgacgaatcacatcggccgttttttgatccgttccgggtgcgcgtcctaatgccaaatctacacgatttggatataatgtttcaagtgttccaaattgctccgctacgattaatggggaatgatttggcaacataataccccctgaacctacgcgaatgtcttttgtatttgctaatatatgttgtacaattgatacggttgctgcacttgcataagcgtcgtgattatgatgctctgcaaaccaaatccgtttatagcccatattatctacagctttagctaatgacactgcagaatcaatcccttgtttcattgtttctccttgtcttaatggagcaactgaaaaaacagatatatcaaattttttcataatttcacctctaaaataatgaacttatacaagatcaatggaaaaaacattttgaaaaattgtttcatattaaatggtgtccattcctctttgatttgcatgcaaataaatatatactttctcaaacgatcaatacataggcaaaataaagttatttcacaatttcactttatttttaaagttttaagcaaacataaaaaaatgttcagtgaacaaaatatgtaaaatacatcttatttttcagaaaggatacaagaaaatgattgatgaaatagataaaaaaatacttgatgagctgtctaaaaatagtcgccttacaatgaaaaaattaggggaaaaagtacatctcactgcaccagcaaccgcatcaagagtagtaaagttaatagacaatggcataataaaaggatgtagtatcgaagtgaatcaagtgaaattaggcttctctatacatgcttttcttaatatttatatcgaaaaaatccatcatcaaccctatttagcttttatagaaacacaagataactatgtaataaacaattataaagttagtggagacggttgctatttgcttgaatgtaaatttccttcaaacgaggtattagatcaatttttaaatgacttaaataaacatgcaaactataaagtgtcgattgttattggtaaatagttaactttataaaacggagatgtgcggtcatataacatgatatatatgctctaaaaaagccctaggttggatatggaatttaccaagctggggcctttttatacattataataacaagcgcattattcatcagacattaatgaagtattataatgcttttttacttccttaatagacaaataaagctgatagtttccatacttcaataaatcattcagaaggtgatttaaaacttcttgtgaatgaaccgttaccttcagaagataacatgcatctcccgaaatacgatgagcttcgctaatttcattacgagtagcaataaatttcaataaatcatcatgcgtatatgcattcatgaaaaagaagacaaaggctgtaaaagaaaaccccatcttcaattcatcaaccacaatcgaatatgctttaatgataccgttatcctccatttttttgatgcgattacctaccgcttgtcctgtcatatgaattttttcaccgatttctttccattgtatccgagcatttttatttaataattggagaatttgaaaatcaattgaatcaatttgcatagtaactcctttcacagtgaaaaagttttacataatagtatttcatgagaccatcgaaaattcaatggaaattatatatccttatacagtataaaaattttaagaggtgaaaaaatgacaacagctttattagtgattgatattcaaaatgattactttccaaatgggaagatggctttaacaaacccagagaaagcagcacaaaatgcggctaaactactttcacactttagaaacacaggcgcacctgtctttcatgtacagcatatcacagaaggtaacatcgctcattttttccatccaaatacagaaggtgtcgaaattcatgagtcagtacgtccattagagaaagagacagtcattgtaaaacatatgccgaatagctttttcaatacagatttaaatggaaagctacaagaagaaggggttaaagaattagttgtttgcggtatgatgtcccatatgtgtattgatgcaacagttcgttctgcagttgaacatggttatgtatgccaagtggtagaagatgcttgcgcaacaacaacattgcaaattgaagataaaatcgttcctgctgagcatgtccattacgcatttatggccgcattaaatggtgtctatgcaacagtaaaaaccacagaggcatttttaaaataaaagaatttcctgcgcgaacataacgtctttcttttcacaagaaagatgattcaacaacttaaaaaaggatgttcagaaaaatacttctggacatcctttattcattatcttttattgtttttcagtatcattattcccatctgataaaagatcaagatgtcctgtttttgatccatagtaagaccatgtacagggattgtttttgccataaatatagatattgatgaaggtttacataaagcacctaattgcttgatttactttaatgttagatccctcaataactccattctcttctaatttctctactctagctgtagctgatgggcatgttaaatgtactctctcccagatctttcattgaattcggctattatacataatttctctataattttttatctgtttgatctatttgaacgttaattcctttcgaaaataaagtcaaagagttaaaacacttttttttatctatgtattcgaacgctgctgatattatacacttaactctgtcgatctaagacaaataaaaaaagaaagtgagttgtaaatatgaatattacacaaattcgaaatgcaacaattgttgtaaaatacgcaaataaaaaatttttgatagatcctatgttagcagagaaaggtacgtacgctactttccctgaaacgatcagacaagatttatttaatcctttggtgagtttgccaacatcaattgataacattctggatggcgtagatgcggtaattgttactcatctacacctagatcactttgatgatgtggcaaaaaacgtattgccaaaaaacatcaaaatgtttgttcaaaatgaagcagatgcaaaagaagtaaaagcaagtggtttcaaaaatgtagaagtgctacatcaagacactgtttttgaagggatccaattagtaaaaacaaaaggtgaacatggcagaggggaagagttattaaacttaatgggtgatgtttgtggattagtattcaagcacccaagtgaaaaagttttatatgtagctggggatacagtttggtatgatgctatcgaagacgagattcatacacatcaaccagaaatcattgtggttaatggtggagacaatcaaagattagatttaggttcactcatcatgggaaaagaagacatctatgaagttcacaaggctgctcctcatgctaagattatatctgttcatatggaagctgttaaccattggacactatctagagaagaattaaaaaactttagtaaagaaaaaggattctcaagtaatattttagtgccagaagatggcgagtcttacacattttaatatgaacaccgacaaataaatagaagaagctcataattataaaaactaatcatgagcttcttctaataatgaatattttaaattttaaatatatcgaaaatcctaaatatacggaataacaaaaatggaatgttccaatgatgacaaaaaaacttgaaaagcaacaaagatgtgtcgttaggaggtagaattcatggtaatgacaaaaaaagatacaaatatatcaacacagcagcctctttggttacaaggttatattgattcaccagaaaaacaaaaccaactttataaaaaaacattaaaaatcttgattttttcacaaatatttgggggagcaggacttggagctgggataacagttggggcgcttcttgcacaagatatgataggatcggaaaatgtagcaggaattccaactgccctctttacttttggatctgccgtagctgccctgcttataggagcatcctcacaacgttttggttgcagagctggacttgcaggtggtttccttataggcggattaggtgctataggtgtgataatcgcggctttaattaacagcgttgccctattatttgtttctcttcttatttatggagcaggtatggcttctaatcttcaagttcggtatgctgggacagaccttgcaaatgagaaacaacgggcaactgctgcaagtatggccttagtttctactactttaggagctgtagtaggtcctaacttagttaatacaatgggggaatttgcagattcaattggtgttcccaatttagctggtccgtttattatgtcaggagcagcttttataattgctggaattattctcttaatttttcttcgtccagatccgctgtttgtatcaacagctattgcgaatgctgagaaaaaagacgataaagtacaaataggaggaagtctaaaaaatcctgctatagacaaaaaaggaataatggtaggagctgtcattatgattttagctcaactaatcatgacagctattatgacaatgacaccggttcacatgggtcatcacggtcatggtttaagcgaagtgggattagttataggactccatattgcagcgatgtatcttccttcaccattgactggtttattagtagataagtttggtcgcacaactatggctattgcttcaggtgccacacttcttgccgctgggttggtggcagctattgcaccggcagactcattatcattgctaatcctagcactagtattactaggggtaggttggaactttggtttactaacgggaactgcccttattatagattcaacacatccatctctacgtgcaaaaacacagggaacattcgatgttttattagcactatcaggagcagcaggtggagccttgtcaggaatggttgttgcacattctagttatacaatactatcaatttctggagccgttttatcattgttactcattccagtagttatttggtattttagaaggattcaggaaaaagcataagcttatataatttgctatacatttaaagaacctaagtagacattactttaaggtggcaacggaatctcctttttttatagtatggagttgacatggcattagtggcatgtgtataactacacaattatttagttgttcgttgacggtctaaaaatagtgcccattttgtgccccgaattcgtgaaaaatgatgaaaataggtataaataaaataaacagacgctttgaataaaagcttttgtaaaccatgatatgtttttattaggttgaaggtctagcttagaaaaccataccaaaacatctcggtatggttttttatattacaattattcaatccccaaaacaactttggaatggaaagattattcttcccaaccctcatcttcgtcaaaatcctctttaccttttttaagttgctgaagaagaaattcaagaaaactatttgcagcagtataaccatatccttcatggttgtcccaaaggataacaggacattctccatctaccattttatttgtatcaagacaataagagaattcatctatatactcaataacaacaagacctggtataagattgtagaacgttctgtattctttggtttgctctacaacttcagctccatgagagtcataaccgagtatcatggtcccgaacgcgcctcctgaaccatactcagttaaaaaccacttataactgtctggtagggttactttgagatctttttctatctctttaatatgtttgtcagtgacgcctccagtaagaattgaatattctttattctcatcaaagaattttttcactctagagtaattcacatttaacctcacatacatttgattttggtttgcaattcatcgatcttattaagttcatactcataatcacagttttcttctaaaacaaaattcatagttttaaagaaacttttcgcattctttaagagtgattcaaaaaaatcaagttttggtagtaatactttttgttgttgtccaatttcaaataacaacatatcattcgatattgatttcattttcaatagaaggggttgatctggaaaataagtttcgctttctcctgtttcaatagcttcttcaattagatttaaaaaataagcccacaattggtcaaccaagtcccacatagtgacatcaagcaaatcttgttcaccatattttaaaataatcgccccagataaatagtaagagtctaactgtgattttatgttctttagtccctctatattgctaagtggaacaaagtaatcgtcaatattattttttaagattgaaagatcgtttatcttcttatttggcctaagaattaatgattcaatataaaacattttacctctcctatttttccggaaaaaattgtcctactcttcctttttgaaagccaacaacatatttttgaccctcatatgttcctcgaatttgataactaaatttagttcctttttttgttaactcttcacggttttgtttcataattgattctatcgcatctgcaacatcgttaacagtcatctctttattaagaaaagattgttgagacttaattgaaccatcccataaattaggatgatggcgctctaaaatatgtttcattcctcgcttatcaatgaggaatgattgtcctccaaaagtgtattttctgctttggaaagtttttaattcgtttacaacttcatgcggcttagctttctttaatccttgtacagtagatgaggtcttgaatatttcaagtgcagagcttttataattctctccatcaatcacattgaaaggaaaagtccctgaaccaccagccattgcataatgttgttcaaaaacatttggtattttaacgtattcaatacctttttttattcctgcttttgaagcttcaagtgccttaattgcagcaacttttgaaccggcttttgcaactttggatactttatcaatacctttcggaccaactattgcaagaacaacagtactgcctacataggaaacccattttgctctgctgtagctatctccattaatcatatcacgttgaaatgtgtcttctatgtcttttgctatgatcttataagtatcgattggatgtaaggctgcgttcacagttccagaaagcgtttcaatcgggtgtcttgcaagttgatagagacccatcactgtatctttacctgcttcatacattcccattgcaataccttttccaatttcagctttttgttggagttcttcgagttggcggaaataaacttgttgctcaggttccaaattctcgtatcctattttcttcgcaatttttaaatactcgtctggatctgttacctttacaagctgtcttttcaaatcttttatttcgtgttttttagcttcttcttttttgatcttcaaataagcttcagattgcttctcgatatcgccttttttcttatgtatatcgctctcacgatatgccttggcattatagtgaaggggtgtagcattcttgcccttacctgttgattcctgtaacttttgaaagtctgctttaatgaattgttcgttaggttcagttattgcatattcagtttttaagttttcgtccacatcgcatattttatcaacagtctttttccgtttgttttcggcagaggagagctcatccttaaaagtctctgttgaaaataaatcaagtggaagaatgtcatcgatatcattcagaatatctttcattgctttcttctgctcagacataattgattttgattttttatatgcgtttgctagttcatgttctaagaaggattcttcgatatatgcatcagataagctggcctcttctagaacaccggagatactagtaaggaaagcgatcttcatttcaattaaatcaatccattgatcagtgacacccacatgatcgtgataaaaagctttaatattgtttgctcccttgccagagaactcactgtcatcaagatcggcaacagccttaaatgcttttcttagcttaatcatttgatttttcaattctttaaatcttttgcgcggttttcagcttcagataacaaagacttagcttcaaataccttcattgtccaatcctttcagtgattttatatccaaatattaccatggataagttatgaagttcgaaaaaattatttaaggataggtaatgaattgaacgaaatgagaattcattggtgtaaaataagcttacatcccatttattacatatagagattggagttaacaatgaaaaaagtaagtttattttagcgagtattgtttctgttgggctgctagtttttttagcatggtttatttatgctggcacccaccaacctcctattttgaagggtaattcaaaagatggaaaatggagtgttatctattctcctgaaaaagacatagatcttgcaaggcaagacttatgggcggttcatattacatggaaaagggattctgagttttcaataaaagaggttgtgtttaaagaaaatggtgttgttgaggcatcaggtgacgcaacagatgaacctaagaatgctaaaaaaatagcagtagcgataatgggagatccaccaaatatgaataatgattatacagtagaagttacttgggaagagaatgggaaaacacaaaaagacattatacaagtaaataaagaaatcaagcggtcttttgttattcctaatgtaataaaaagaattttaagtttaggataaagctaaaatactctcatggcataaaaatttttaaaaagcaggtaaatagcgcctgctttttcgtgtttaatcttaatttttcaccttaactgattacttcgagcagggctgttactaagtaaacatcaataataaggtaatttttttaaaagaccgctactccaattttactcctcaatatgaataaatcattataaaactttataatcaatataaataaacactgatatataaaggttttataacagaaaacaaagattcactttattgagggcccagtgggggaataacccgtaaaggttcaagttctctcgaccgcatcccaataataccaagggcttaaccatctttggtgttattttttgcggaaaatacggcaacaaatgtaccgcattgtggagtcgactaaaaaagtgctgacctctgcacaacatcgttgcgcgagtctgcacttttattctgcgattatggggagtttattttaatccgttgttagccgcgccgatacttggcttttagaaactttttttaagtggctaaaaccaacaaattttttgccttcttcatcccataggcggaactttaacgacttaaggcttgttgccagtgtaatggtcggaacgttttgcaatggttcagtgttgttatgcactttttcaagcttatagtttgggactctcgggcttaaatgatgaacatgatgaaaaccgatattgcctgttagccactgcatgacttttggaagcttataaaaagagcttccttcaactgctgcttttacatattcccaatgctcatcttcttcaaaataagaatcctcaaacgtatgctgaatataaaacatccaaattccgagagagcccgatatcataaaaatcggcacctgaaccagcaagaagttttgccagccgacagcccaacatattagtgctgccaaagcgacgatccccaggttcgttacatacgtattcatccgttctttgcgttttgccccttgtcgattaaaacgattggcaatcccgaagacgtaaatcggcccaataataaacataacaaacggatttctgtacaaacggtacattatttttgtcttagttgaggcttctttatattcctctaccgtcagtacccaaatatcgcctgtaccgcgtttgtccagattgctgcttgtcgcatgatggacagaatggtcgtgtgcccaatgatcaaacggatgcagagtcagaattcctgttaatgttccaaggattcgattcgcctttctgttcttaaaaaaggaatagtggcagcaatcatgaaagatgatgaaggttctcactaaaaaacctgccgcaacaacagaaatcgctaacgtaaggaaataagaaatcgacaagctcttatatgccaaacaccataataggaaaaatggtaccaatgtgttaatgatttgacaaatgcttttgtgtaaatcggacttttcataaggtgtaaccagttttctcaaagtccttaggttttgttctttcatattaaaaagtttccccttccctggtgatcttctaagtgtagaaaacgttttatagcctttgaagggcccaacgtgatacaccccatatatgataagtatccttcccattcatctgtgaaattattggaaatgataaactgatttccagttcaattacatctttattagcagagtcagccgggatacaaaaggtgtatgaagattatacccagcacattatcgggtcaaactctctcactgctcccctatggaaatcgatttatttagaccttgaacattgattgtttgaggaaaaaaaggttttggacagtgataatgaagtaatggggatatcatgagtgactgtttggaaacatctgcagaaacaaagttttacaagtgaacagccctgtgttttaaaagattatcttgcacttgaacaagaaacagctgagctattcattaatgaagtactattaagcaaagaaagacactcgtggttcatttttcacgttgttttcaaaccaaagtttttaataggcctcttattctgcgctggtatacacatgtttaacaaataatgccatgaataaatcggaaatataatttgcagttatttccgattcctgatataataaagaagaattatttttgttcggtgtaaaggatagtatgaagattgacttttcgtcttgatgatactttgggcaaggatagtatatactgtgtggttacacactaggaggcaacaaaaatggaacaaggtacagttaaatggtttaatgcagaaaaaggttttggttttatcgaacgcgaaaatggagacgatgtattcgtacacttttctgcaatccaaagtgacggattcaaatctttagacgaaggtcaaaaagtatcgtttgacgttgagcaaggtgctcgtggagctcaagctgctaacgttcaaaaagcttaatcttcaatcgtttatacaaacaggctctttatatagggcctgtttttttatgtctatatcatactcaataaaaaaccctactcaacgttcgagtagggagatgctacaaggtatagaaaaagatttaaaacttcaaaggtttgtttacagtataacatactggattgacaatatgcggaatgtatataaaatatttaattttttgttgaaatatagataactcttttttttcactaacctgttcgttcatttaagtaagattagatgaattataaaaatggtttcatctaaatgttatcaactcgcatatctttttatgagaagaagataaacaattattattcaatgtggcagtggatataagaaattcttaaaaataatgaggagatcgattgtttttttcttctggaaataatcacttagagatacctaaaacaatgaaagccctacctctcttccatccttacggctccttgtccgtgccagtgtgaatcaggatactaaaaaaagtgactattttattgagttttttggtaaaacttcaatcttcgcagaagaaatgtaaataataaaaatggattagaatgtaggaataacaaaagaggtcgttaatgttctaaacataagttggagaagttttgcttttcatcataatattccgaaatatcttttgggatgtatctaaccaaaactttttatttgtttttcagtgattcctttaattacttccagttcactaatcaaaaattcatatgcattatccagcatttttttttcgcttgcattaagtgctttttctttcttcatacgcattaaatcacgtacaacttcagcgccttcttgtatttcacctgtttttattttgtccgtgtttattttatacctttgcttccatggcagtaacctatctgattctccatgctgaaaaatgtgcataatgtgttttaatgcaagtatatcggtaactggtcgtatattcgaactcaatattttactcgttggaatcataactgtcatattactgattgacattcttatgacataatactgttgtttttcctctaagaattctttttcttctatggcttcaattatacctgctccgtgcattggataaacaatgttatcgccaatttgaaacatatcatccacctccatatatggtatccttcttaagattaccatatatggaggtgtaatatcaaaattttaataataacatgatcgaatttttgatgtcaataacttttttgaaaaaacagatcaagcaaaaacaatagggaacgtgtcggatttccaatcaaggaaaaggtcaattgatccgtgtatatcctaaaacttcgactaattaacatagatcagtttttcattgaaaatgggttattccatttcctttaggaattcatgacttggctcaatgacatcacagaaatgatttgagtagaaataagaaggaacgatatttgtgaaatgtcagctaaaaatatttaaagcacatgattaagttctaatttctttatcgatcgttctcaaatttgatatggataacggcccacttacttaatgatgcattttcacttatcttgcgaacagaaaaaggtttgtggatattgaacattttgccacagagattggcattattatcagggaaattgacaaccttcaaatgggtattgaggtgagaagaaaaataaagaaaggagagattataaatgaagaccagaacataaagaagtgaaggggaaagaacaaggttaattgaaaagcaaactatataaaatagtttgctttttttgttatgaattcacttctttttcttactctttaatgactaataaaacaccgctaagaattaaaaacgaacctatccaaaatgtcccgcctatttgttctccaagcagaatccatccgagtaaggttccaactagaggctgaaaaaagaaaaagaggcctccacttgaagcatttaataattgtaagccgcgattccacaataaaaaagcacaagcagttgaaacaattcccaaatacaaaagaccacctagaattttagggtcatgcagttgtggcgtaaaatcgtgctaggggagtatcattaacagggactccatttattaatagaataaaccttatgaattaatgtctcatatgaatttttttgtaggataatggcgtcatattcatcgcttgttgaaatttacttatgaaataactggtactgttaaatccaacttgataagacacttctgtcacattggattcagggtgttgcagtaataataagcttttttgaattctataatccattacataacgtaatggcgtcttattcagcattcgtttaaaataacggcagcactcagaacggctcagttggccagcttttgcaatgtcgtctaatgtgattttttctgcataatggagatggatccagtttaacatttgtttcattcgatgactttttatcatttcagattgatcgtactctaattgaaaaccattaacgaccaggtttttccacattaacgttaattgcattgtaatgtcaatctcatagagcgatggcttttgttgaaccaattgatttatttttttaacagcttctagaatgttttttgcccactgttgatttccatccaaaaataaatagggtaaattggttgaaaacatatagggctgaacatagctggaatacagttcttgagataaaacgaaatggggtgacacatttaagcaaatatacgtacaatccgagccttccttttcttctgccatgtgcaggcagccgctattgataaataatccatccccttcgtgaacctctattttttctttatttatttgaaagagagctatcccttttagtatcaaaacaaattggatttcatcatgccaatgaagcggaatatagccatttatattttgattgatcgttgtcttgtagcaggcaactggtaatactaccgttcggtgctctgttaattcttttaaattttgatcgattacaaaattcttcattctgacttctcacctcaatatatttatattttttcattcgatttgaatattttttatcatgttttacatttattataacactattattatatttattagtgaggagtcatgtatgattacttccaatagaagaatgggattgttctatgttataacaggggcgacatgttggggaattggaggcacagtagccaaaaaactttttcaagaatatcaaattgatgtcaattggcttgtaacgacacgtttgcttacggctggaatgttacttttaatgctgcaattgttcagaaaggatcggtctcaggttattgaggtttggaaacacaaagcgtcggctggccagcttcttatttttggcctattgggaatgctagctgtgcagtacacatatatggcatccattcaacatgggaatgctgccgttgctacgttattgcaatatttatccccagtaatcgtcattatctacacgctgttgcgaaaacaaacggttcttaccaaacaagatatcataactgttgtacttgctttagtgggttgcttttttttgttaacaaatggttcaatgtctcaactttcagtgccggcagctgcagtagtatggggagttttatcaggattcgcggcagctttttatactttgtatgccgttggtttattaaataaatttgattctcttgtcgttgtaggttgggctatgattattggcggttttgcattgggttttatccatccgccatggcaactggattttcaacgattaactgctgaggcgtatgcatatatcttattcgtgatattatttggaacaatgattgcgttttggttcttcataaaaagcttggaaagcctctctcccaaagaaacaagcctactaggcagtctagagcctctatcagctgttgtaacaactgtcgtttggttaaaagcgccatttggttcttttcaatggattggtgctatttgtattatagggataactttaatattggctttacataaagagccttctatggagagtgaaaaatcgatattaaagattaggaatcatgcaaatcgggatatataggggctttttttgcttacatgaccggtccggcaatgaaaaacactggtggagtttgagccctctcggcagtatcaaaaataccaagggttttgacgcccttggtattttttcttcaagaaccttcaattcttcttctctgatcgaaaaacgtattacttttttgtaattggtatccaaatttcacttttaaaagatggtgatgttacatccttatgctcgttccacaatatttctggaccttctatttgttcgtaatttgacgatggaaaccattcggaataaatacgtccccatacttcttgcagtgtatccggaaatggcccgattgattcgaatacagcccacgtagaggcaggaacttcaagccttgagaagttatctggacactgtttcgttgtggctgcgccaatatagtgatcgagctctccgttttcctctgtccgaccttcagaaaaattcgtggatgcactaatgaggcctgatggtgctacattagaaagctcttttagtttatttattgctttttcatctaaactttcccacatagatgcaatttctggattaattcctttgaaaataataggaactctttttttaatgccaacgatgcgaaatgcctctttttcttcaatacggtagttcatttcatttcctcctttaattgttagctggaaggtcattcgtggataagctttaagggaatggccattaagtctggcttttgatgggtttatgccatgtaaattttggaatgcccgtgcaaaagaatctggtgagttataaccgtactttattgcaatatcaatcacttttacattgctgtctttcagttcaaaagctgcaagagtaagacgtctgcgacgaatatattccgataatgaaatacctgcaaggaaggaaaacatccttttaaaatgatattcagagcagaaagcaagctttgctgcctcttgaaaatcaatatcattagtgaggttttcttcaatatactttaacgccctattcatacttttaagcaaatgcatttatttggcctcctttaaccaaagaataacaggagtgaaatgtatttatccgacattctgtgcacagttttgcaggatgacttatatgaaataaagtaagtgattcacttgtatttgtacaggttttattgaagcatgctgttcataaaaaagcatcaataaaagaaagttataattgtcttataaacggcacattcatataattgagtgaaaaaggatgcgtatcatgcctatcaattcttttgaaaactatccgatgagctggaagccatcaattgataaagctgaaaagcctatctataaagcacttgcagggcaattggaacaggatattataaacggagttttaatacctggaacaaaacttcctccgcagcgagaattggccgattatttagatttaaatgtgagtacgatttccaaagcatttaaagtgtgtgagttaaaggggctgctgagtgcgactgtagggagcggcacatttgtatcgtatgatgcgttgtcgaatgcgtatttacttgaggatacaaagccgacacatttaattgaaatgggagcgacacttccagatcacgcttcatatgagcccttgttactccaactgaaaaacatggttcaggaggaggattatgaaaaatggtttagctacggccgggcaggcgaaagcctttggcaaaaagatgcagctgtaaagctcatccaaagaggcggatttgaaacatccgttgatcacattttatttgcaaatggagggcaaaatgcgattgcagcgacattggcgagtctttgtaagcctggagatcgcatcggagttgaccatcatacgtaccctggattaaaaactgttgcatcattgcttagtgtgcaaatcgtaccgataaaatcagaaaacgatgaaatgagtccggagtcacttgaatatgcgtgtaaaaacgaaaatattaaaggtttgtatttaatcccggattatcataatccaacgacttcctttatgtctgttgagaatcgaagaatggttgcagacattgcaaagaaatataatctatttgttattgaggatgcatcgtaccatcttcttagcaaaaagccgcttccggcactcgcctcattcgcaccgcaacaggttattcatattgcaagtttatcaaaatcgttagcgccaggcctgcgtttggcttatgtagcagtgccgagacaatataaggagccaatatcaaaggcgctttataatttaaatataacagtttccccgctattagctgaacttactgctcgcacgattgtatcaaatcagtttgaagtcttaattgagagtcatcgtgaacaaaccattcgcagaaatcaaatcgtaaaccgttatgttgcgggatatacatgtttaggtgttgaaacaggcatttttcgttggttgatgttaccgggtaaaatgactggcgctcaatttgaagagttggctgctcgacatggcgtgcaagtgtatgcggctgaacgctttgtagtaggcaatagttgtcctgaaagggctgtaagggtttctgtctgtgcaccaaaaacactcgaagagcttgaacaaggattaatgatcctgaaacgtttgctagacgatcttacttaatattgtttgccatacaattatgacattgtatggcttttttgtgcgtgttatgatgatccacatctagagggaggtttatacaaaattggcttttagaaaggaaggtcagaagatgttagacaaggacagcgtaaaagcaatagatgttcaaactgcttcgttacaaagctacatcagttcaccagaaaaacaaaaatcgttatacaagcgtacactattcgttgtgagtatctcacaaatttttggcggtgcggggctggcggcaggagtgactgtcggtgcgcttattgcacagcaaatgcttggcactgatgcgtttgctggtcttccttctgctttgtttactttagggtcagcaggatctgcattaattgttggaagactttctcaacgttatggccgtcgaacaggtctttcagctggctttatgattggcggacttggagcaataggcgttattatggcagcaatcataaatagtattttcttgttatttatttcgttgcttatttacggtgcaggtacagccactaatttacaggcccgttatgcaggtacagacttagcaaatcataagcagcgagcgactgctgttagtataaccatggtttttactacatttggcgcagtggcaggtccaagcttagtgaatgtgatgggggatttcgctctttctattggtgttccatcacttgctggccctttcattttagctgcagcagcatatatgttagcaggtgtggtccttttcattatgcttcgtccagatccattagttatagcaagaacaatagaagcggcaaatgaagagcctggtgataaaggacatttggcggcaactgagcatacagaaaacaaaaaagggataatcgttggggcaacggttatggttcttacccaaatagtaatggtagctattatgacaatgacaccggttcatatgagacatcatggccatgacttgggtgcagtcggtcttgttattggttttcatataggtgctatgtatctcccttcactggttacaggtgttcttgtagataggttgggacgtaccgcaatggctatttcctctggaacaacgttgcttttggcaggtgtaatagcagcatttgctccgggagattctatggttcttctcgtcattgctctttctttactgggattagggtggaattttggtttgataagcgggactgcccttattgtagattcaactgatactgccacacgagctaaaacgcaggggacagtggatgttctgattgccttgtcaggagctgctggcggagcattatctggaatgattgtggcaggttcaagttacctcgcattatcacttattggagggattttgtccttattactcattccggtggtggtatggtctaggggccgctaaagggtaggattgtttaatttacattaatttgttatattgttagataaagtatattgcagcatctaatattctaacgaactatagttgctccattaaatctattataaagatttgaccaggattccttatagctgtgtcactcactgcatattctttaattgaatcacataaaatggttatcggatttgaaaaaggcaggattactcgctttaggtaaaggagtcataacgttgttaaaaaggttttctcttgtttttgttacactaatgatgtctatcgttgttgttttagcggctgctaaagagtcgcctggagatcatgtcatctcatttgatgaacctcttatcttgatgatctcaattgggatcgttgtatttttatttatccctccattagtcatgtccttttttggcaatttggttgtaagaataatatctggtgtataccaatgttttatcgttttcacttttctgggactcattccaattggatttcttattcccaatggctttttgacaattctagtttctattgcaggaactttagtcagtatagctagtgttgccgtaaccttatgcattggcaagaataaaaaagatatataatcatcgaattgttattttttcagattgtcagtgaaataattatacaaaaagagaaggcttgtgggccttctttttttgttgttgcatcatccctactttaagcttaatctattgaataaaaagagaaggaacctatagaagaataaaataaataccgagatgtcaaaaataaaactggacttcattattgtgaattcacgtaaaagtaaaaagattggaaagaggggaattccttcatgacaaatagcagaacaaatccgaaggttgatgaatttttaagtgaagcgaaaaagtggaaggaagaatttgagaagttgagaaccatcattcttgactgtgagctgactgaagattttaagtggatgcatccttgttacacatacaataataaaaatgtcgttttaatacatgggtttaaagaatattgtgcgcttctgtttcacaaaggtgccctattacaggatgcccatggcattctcattcaacaaacggagaatgtacaggcggcgcgccagattcggtttacaaatgttcaggaaataaatgagctagaaaacattttgaaagcctatattcacgaagccattgaagttgaaaaagccggattgaaagtggatgttaacaaaaatattgaattgaacattcctgaagaacttcaaaataaattcgatgaaatccctgccttgaaaactgcttttgaagcattgaccccgggacggcaaagagcgtacactctttatttttctcaagccaaacaatccaaaacccgagaatcgagagtcgaaaaatatgtgcaaaaaattctcgatggaaagggattaaaggattaggcacgccaaggttcaggctaaaggaatagcatcatagcgtaataagatcctttctatagaagaaaaacaagcatagtaagatgcttgtttttcttaggacaacattcacttactgctgaaatgcttcttttgattaacattgtatgccactagacagcgttataaaatattaatgcaacacctagaaatagctcaatggcacggctcatcacatttagaatgcctaggagaactaatagaaccggaagatttttagcaagttactacactccaaactttgttttttgtattaatataccttattaaccattgtttttagtcaggtgcagacaaacgaatactgattaatgaatcatcatgatatcgatgatccgcttgattttttcattgtcacctgtatcaacatacactgtttttctgttttttatgatattctcagtcacttccctcatgacgcctttttctacatcatcagcagaatcccatcgtaaaggcacattatatacatgaatcgtgccatccccattgccatgataagtgactgatccatccactaaacgagaacctgctaactgggtcacattttctggatagctggcacttgtatcatcattaggattaattggctcgccagccgcaatatgtcgaacatttaattcatctatctcttgattaggtccaagttgaagccaaactctggcatattcaattttttcagaagagtatgctgccaatacattgtcttctttgcttttctcttctgctgaagaggtattatttgcagcttttgttgcggattcttctgattctgttattggctccgcttcatccttgcgtattttggtgctctcttcaggctcagtgtgtttttcgtcagattgtacagcagaagcttgatttgaaggttgttgtgcttctccatccttactgtccgtacatccagcaagcgaaatcatgagcagcagggcagtaatacaaaaatatatctttctgtgtttcttcattctttcattcattcattcctctccattaactcaggtcagcttcatatataagtttatgtatctaaatattaccatggaatagataggatgatattgaaaactgtttaagaagaggaaacgatcttgaatagcatcgcgaaaacttaagaattcttaagaagttttgcccctttttcttcaggttttgaatgtaaagtgggatataaatgcaaacaaaaacgaaatgccttatccgcctcgtgtcatggcagaaaaagtgggggatttattagagaggattttataatggcggcaggtaaatgggtgttgacttatatgtctaagcgggagactcaagtctgctcgatcgcgtgcaaaataccaagggccagcaacccttggtatttttataccttcatgcatttttgaagtttacgataaaggtctgccttactttgcaaatcgccgtgcagctgcaacgcacatgataacggcgatatttactgctacgagtgcccagcccactttctcgtgcagaatcactgaggcaagcagcagtccaaaaaaaggctggagaagctggagctgcccaaccgccgcaattccgccttgggcaagaccgcgataccagaacacaaagccgatcagcatgctgaataaggatacatatgcaagactgagcagtgcgggaacgccgatcgccgaccatgagtccggcgtaaaaaagaacgacaatggcagcataagaggaagcgacagaacgagtgcccatgagatcacctgccaattccccagacgccgtgaaagccttgccccttctgcataaccgagaccgcatacgacaatagaagccagcatgtacgcgtcgccaagcggggatgaacctcccccctgaatgagggcgaaacctgctactaacaagctgccaacggctgagaaaatccagaaaacggggcgggggcgttcaccccgcgcagtacgccgaagaccgccgttgcaagcggaagaagtccaatgaagacaatggcgtgtgcggaagtgacatgctgaagcgctaaagctgtcagcaacgggaaaccaatcactacgccaaacgctaccactaataatgaaatgaggtctcttttggaaggatgctgctgccggaagatgagaaggagacctcccgccagtacaccagctatcgcagcgcggcatacggtgaggaacagcggatcgaagtccgacacagccaaacgggtcgcaggcagcgagccgctgaaaatgagtacgcctataaaaccatttatccagccatttgttcgtttgttcattacaatcactccacatatctttcttgttcattgtctgtattttcttaacaaaaccagcagctaaggattacaatgactataaactggaattggccttttataaacagccagttttcataaaaaaatgcataccagttaggagaacaacgcgcaaatggatatcacgccttttttggatagaaatctggatagtccactttatcagcagctttatcgatattttaaagaaaacatgcatcggggtcgtattcaaaaaggaatgaagcttccttcaaaaagactcctggcgaatcagctttccatcagccaaacgactgtagagcgtgcctatgaacagctcgctgctgagggctatattgtgagcaagccaagaagcgggtggtttgctgattatcatgattctgattttgcttatgatagaatgccaagcacaacacccattcaacaagaagcagaagaaaataaacaatcgattgattttcattatgggaatgtagattcttcttacttccctttttccgcatggcgaaaaagcatggtcaatagcttagaccaatatggacacgagctttatcggccgggacatgttttaggagagtttgagctgagaacactcattgcagagtacctgtatcaatctcgggggttcattgcggccctgaacaagtgattataggtgccgggaaccctattctgctgcaaatcttgtgccaagtttttgagccgaatatttctatagggtatgaggatcctggttatccaagagcacgcaaaatttttgaggccaatcgcatgaatattgttccgataccagtcgatgatgaaggaatctgtatacagaagatcaaagaacagcagccaaaccttgtatatgtcacaccttcccatcaatttacgctgggaaccataatgacaataaacagaagaattcagctgctcaaatgggcggccgaacatcaatcctttatcatagaggatgattatgacggggaatttaggtacacaggacagccggttccttctctgcaagggcttgatcagcataaccgtgtcatttatatgggcactttttctaagtctcttttgccctcgctgcgtatcagctatatgattcttccttcgcctcttttaaaaaaggggcatgaaatcacgtccttatataagcaaacagtgtcctgccacagtcagctaaccctagctgaatttataaaaaatggagagtggcaaaaacacatcaacagaatgagaaaactttaccgcaaaaaaagagccattgtattagaggcagtgcaaagggaattaggagagcatgtcagaattcgcggagaaaactctgggcttcgtatcttacttgacgtttatttgccatttggtgaaaaagagttaattgagaaggcgaaaaaacatggagtaaaaatttatcctgtttctctttcttatcaacatcatcctcttacaaaaacggtctcgctcgggtttgcaggagtttctgaatccgacataagagaaggcataaaaaaactgaaggctgcctggaagatatgagggagctttcagtttagcaaaacggcaaagtgacgactaagtgttgagagctgttcaatattatttaagtatatgatgagtgcctgcagtcagtccaggccacgatacgtctgtttagcgaaaacagaattttttatttgctcatcacagtgctaaaataaacaaaatagacaattgaaaaaatagaggtgtaagaatgaagttagatgagtttacaattggccaggtcttcaaaacgaaatcattaaaagtatcaaaagatgatattatgcggtttgcgggtgaatttgaccctcagtatatgcatgtagatgaagaaaaagcgaataaaggcagatttaatggaattatcgcttccggcatacaaacactggccatatcttttaaactttggattgaagaaggtttctatggagacgatattatagccggaacagagatgaatcatatgagattcataaaacctgtatatccggatgatgaattgtttacaattgttaaggttcttgataagcagccaaagagaaatgaattgggaatactcacagtattgctatctacttataatcaaaaagaagtaaaagtgtttgaaggtgagttatctgtattgatcaaacgataactcagaaagcccgcttttcgcgggctcgattgaagcagatgggtgaaagatgttagcgagtttcctttgaaaaataagaggttaaaacatcataaacaataggcaaagaagtaaatccctcatcttctagaaaatgacctccgtgctgaacttcatataacgcagcatcaatttgttgtgccagatccttgctgaatgaaaaaggcacaatttggtcgtccttagaagcaatgacagcacggtgcttcgcggactcaatgattgtttgatgatcaaacgatccctgtgtaaattcatctaacatctttaaagtgggcaatgatttggcaaagccggaaacaagtatgattccgccaagctgttttcgtaattgaagatgttccaaaaatctcaaaatggcggggcaacctaagctatgcgcaaccaaatacgtattttcatgtaaagtgtgctgatataaagagagtgtatccagccaatcctcaagtcttggctggagcggattaggcatgtttaaaatgtctgcttggatcccatctgcgagcaggcgttttttcagccaagggaaccaatgatttgttgaggaggctccgtagccatgaatgatatagacttgttttgtcattttttcctccacacgaagcattttcattcagtataaaattcctctcaatgggaaacaagtacgcacttttttgtaagtagctttacatatgaggcattccttgtgccattccccacttacacatttcatctatgagggggtacaaagatcgccctctgtcagataacgaatactctactttcagtggggtttgagaaacctcagtccgatgaataaggccgtcagtttgcaattccttaagctgtgcgcttaacattttatgggtgatgaagggcatagcccttttcagctcgccgtatctcatcgttttttcacaccctaactcatagaggattctcattttccatttgccccctataagagataaggtgtattcaaatggggcttgtttactgcggcacaggttattcattgtaatcaaacctccttttttaagtatcatatcagaataaattaggattttcggtgttgaagtttgagggcgattcacgatctgaagtgaaaggggccgcttgctcaacaggcgatacggtacatgaatgttctaagtcaaagagggttaccttactgttaattactttatttaaaaaaacgcatgtttttagctgaaaatatctattatggtatatttaaatataacgaaatatttgagaaatgaggaatggtatgaatacaaccaaaaaacataagaaatttaaagcgaaaatgattttccaaatcatcatggttatcattggaggaatcatagcggcgtatggactagaaacagtgctcattccaaacagtgtatctgatggaggggtgacgggtcttagcatcgttggttcacagctattcaacttgccgctggggattttgattgcagtgatcaacattccatttgtctggttaggatataagcaaatagggaaaagctttgcattattatcaattatcggaatcgtatcgcttgccgcggggacaagctttttccaccacacacccgcaatcatagaaggagataccctgttaattaccgttgtcggcgggattatccttggatttggaatggggctggcgctgcgtaatggcggcgcattagatggtattgacatgcttgctgtgctgctatcccgaaaactgcccttcggaacgagcgatctcattctattcttaaacctatttgtgtttatttttgtttccacagtatttggcttacaaggggcattgctttcagtcattgcttactacattgcatccaaagtgattcatgttgtggaggaaggcttaagcggctctaaaacctttcaaattattacaacccaaccagaattaatggtagagacaatacgtgatcaattaggccgaagcgccacatataaagaagcttacgggggtttttcccacgagaaatttaaagaaatcacatgtgtcatcaaccgtttagaagaaaccaaactaaaggaaattattaatgatattgataaatccgcctttgtcaccgtatatgacgtagctgaagtgaagggcagcaattttagaaatcttaatcatcactaaaaaatagaatgacctttttaaccgtaactgacatgccgcgggtaatttaatcaaaaacacttttttgaggcttgtgggtgaataaccggtgaaggtctcaatcataaataccaagggtatcaaaacccttggtattttttgtattttgctgattgctgattgtattatgctttcctgtccgatatccatttcagttactgatttgggaatgaaatgctttgtccgccataagtgttgtcctggccatccttcctgccaaaaaccaaaagcaaacacaagctatattgccgtactcggttcaatgtacaatgggtaaaggaaaataaagagattgatattaattgaatcaaacatatttgatgttccaaatataagggattgtttatataaataaaagtttatataatgacggtggcgctaaggtaacgcggggagctactcaggttttcgtttcgtagttttgatccttaagatatacggagcgctacatatggaaacgtaaaggggaatgtagaatcatttggcgtgtatataatgatttgcttatatattgatttgggaaggaggagctcatatgacgattgatgttgcggcgatgactcgttgtttgaaaacacttagtgatcaaactaggcttataatgatgagattatttcttgaaaaagaatattgtgtctgtcaattggttgatatgttcgaaatgagccagcccgccataagccagcatttgcggaaattaagaaacgcaggttttgtgaatgaggacagaagaggccaatggcgttattattcaataaatggttcctgtcctgagtttgatacattgcaattgatcttacatcaaatcgatcaggaggatgaattgttaaaccatatcaaacaaaagaaaactcaagcgtgttgccagtaaggaggcattagattgacatcaatgattttggcagtattcatctttttattaactctagtattggtcatatggcagccgaaaaatttatctatagggtggtcagcctgtggaggcgcagttttagctctaatagcaggtgttgtcaattttcatgatgtgttaactgtgacagggattgtttggaatgcgaccttggcttttgtggccatcatactgatatcgttaattcttgataatatcggtttctttgaatgggcagcgcttcatatggctaaggctgcaaaaggaaacggtgtgcggatgttcgtttatgtatctctattaggagctattgtcgccgcgttatttgcaaatgacggtgcagctcttatattgacaccaatcgtattagcgatggtcagagcattacattttaatgaaaaattagtttttccttttatcattgccagcggatttattgcggataccacttcgcttcctttagtagtgagcaatttggtcaacattgtttcagcggactattttcatattacgtttattgattatgcatccagaatggttgtcccgtacttgttttcgctgctggcgagcatcattgtactttaccttttctttagaaaaagcataccaaaacgctatgatctgactgaggttaaaaaacctgttgaagcaattaaagatcaaaacatgttcagactgtcatggtatatcttagggctgctgttaattggatattttgcaagtgaatttttttctatccctgtatcagtggtagcgggcagcattgcgatcattttcttaatcgctgcgcaaaagagtccggccgtccatacaaagaaagtgatgaaagaggcgccatgggctatcgtattcttttcaattggcatgtacgttgttgtgtatggtgtccgaaatgccggattaacggatgtcctttcagatgtgattcaagccgcagctgatcaaggattgtttgctgggacaattggaatgggctttattgcggcgattctttcttccattatgaataacttgccgactgttatgattgacgcattggctattgccagtacagatacacatgggatgatgagagaagcgcttatttatgcaaatgtgatcggttcagatttaggacctaaaataacaccgattggttccttggcgacattattatggcttcatgttctttcgcacaaaggtatgaaaatttcctggggcacgtattttaaaacaggaattatcctcacgatacccactttattgatcacacttgtcggcctgtatatttggctgctgataatccattcttgtttctaaaaggacaaggtcactatatcaaggaaaacaatgcactggtaactcttgccgcagccaaatggctgaagggtgggggagaaaataccttggggacaagtggaatgtgtacagcgcaggaatcgaagctcatggatgacatcgagtgctgtcaaagcaatgaaagaagcagggattgatatttcaaatcaaacatcggataaatttgatgatccggcaaaagcacacggaacagaagaagtgttttcaaagggtccgtgctgaaattggtgaccgtttaaaacagtttgctgtaactgggaaataaagaatcgatatactcagcgttttcttgggttatataatgcaatgtgttgttcaacaggtgtctgcgggctgagtgcagacacctgtttttgttttttatttgtctgagattcgtaacagggaagttatttagctagtgacagaggaaaattgattttgtgaacagaatcaagaagaagacggtgttttaaaggagttgtctgttttgcaggaattaacaaaagaaaagtatagtagcttaaaaacaatgtttgatgacaaatattgtcccacatttgtctattcaatattagaccaaaccattccgggagctgtttatgcagatgatcaaacctttcctaaatcgttttttataggaactgaatcaggcatttattttattgcgggagaccaagggaatcgggattttcatgatttcattgcaggatattatgaagaacaagtgaaatcatcaaaacgatttaccttgttttcttccagtgatacatgggatagcgtactgaaacccatactgaaagatgacttaaaccaaatgagaagagctgcattttcttatcaaccaaaatattccaaaaggactttacaactgccaaagggtcttgtattgaaaagaatagacgaagacatcatttcacacagcacagcgtttaacagcgcgtattatgaggagtattgggattctgtctcacagtttgcttcaaaaggttttggatttgccgtattacatggcaatcatgtagtaagtgagtgtacttctatatttttagggcataatcgagcggaaatggatatctatacacttgaagaatatagaggactggggttagcttattgcgtagcaaataggtttatagcgttttgtatggaaaatgggattgttcctagctgggattgtgatatctgcaacaattcgtccattgcattagcagctaaactagggtttaagaaaataatcgaatactctcttttttattccgggaaatcataaaaaagagaagaggcaagaactcttctctttacatgagtaagcggttggtgaataccggtttttattttattaagaatctagatttaattgctggcgaagtttcttcgataagtcctttctcgtttcatcagttacaacatgataccataagtgatctatctttttatcctcaccttttatttcgatctgtttgacatgttgaacggcttctttataagagcgttgaatatcaatcattttatcaagtgttaagtttgtttgtatatttttttctaaggcagccaaaattccttgatagttttttaatgattttaattgtgctccttcgtgaataatttggttaatgatttctcgctgccgcttctgccgcccaaaatcaccgcgaggatcttcttttctcatccgtgcgtatttaagggcaacctttccatccaggtgctgttccccttttggtatatgcaccccttcaagggtaaaagggaaatcattattcactgtgattccgccaatctcatctacaatatctttaaacccttccatattgactttgatataataattgattgggatgtttaaaaattgttcaacggtttgaacggcaccttcaataccctcgtaagtatatgctgcattcattttaatattggtattctttgatcgcataaatactctggtatcacgcggtatacttaccatcgtcgatgttttcgtctctggatttaaagtcagtacgatcatcgaatcaggtcgtcctttatcaccggggcgttcatctactcccagcaaaagaatcgatataggatcatgcccaagactagcatcttgttgcttagaatctctttgcagaggttcatacatatggttgaccgattttgctacgtttcggtaaatgctatagcaggtcaggcctccaatggttaacaagagggctagaacaaacaataaaatactctgcattttcagtttccttctcccaattttcactatcaaattccttcctgatcaagttgaatatttatatgttgtactggttcttaacggttctctaataaataattcttttatcttcgtgatattttgtagttcataaaagatactttaaatatatacttcaattgaatctgaattgtaccggtttgattgaatcatgaattgctttcatttcgtatccgctttcccggaaatattttaataattgttccaaatacgccgcggtagtcggcttttcatgcattaatacaataagcggctcttttccttcaagggttttgacttgctgaatgacactcttaacaaactctccatgagtgtacttccagtcctctgagtcaactgtccaatcccacaggttaaaatgatcacgctccacaacatctctaaaagggccagtaatgtaaggctttgacccgtaaggtgctcttattaaatgcgtgttgactttggttgtttctttaatgtagtccaatgtatcgttcatttctgcagcaaagctttcaggggatttatagatttcggaaacctggtgcgtcacgccgtgagacccaacagaatgaccgttttccgccatttttctcacaatattaggatttcgctcgatatttggttttaacataaaaaacgttccctttgcattgtatttatgaagcaaatccataattttctctgaagcagcagggtttggtccgtcatcaaatgttaaataaacgaccttcccgatttcagcaggttttttttgttcttttttctgtgctgaatttttgtgtgtttctatatgcgcctgctcagaagcgtttgtactttcttttattggttcctgctttgggccggcaagtgccttccaggaaatgcatagtaacgttacacctagaataatcaatatcccaaaacctatttttcctatttgattcaacttacgatcccttcttggtgaatttgacactttttccaactcctcaattgtagatatcaaaactagttttctcgcgaacgagtcacataaattagaaggaccaatggagacaaagcccagtaaaaatgatgctcttttaatatagatgagagttatcgcagaagtttgatcaacttgtaaacataatgtcaacaaatgaaggaatcattgttatgtaatatcttgcaggtataagaaaaaaccttatttcaatagaaataaggtttacttgaaggatatgatataagagcgatcgtcaaaaaatcgggctgatgagttttccatagaaatataccggttttgttcataaacgagcaggttgctgccatctggactccaatatatttctgatgggctggtgccgtggtatataggttctgcgtagaggacatttttcccttgcagctttcctgcataagtattgtccttgtcatataaagagtaagcgatcttctttcgatcattagatatggtaaaaacagctacattttcgagcagaacagagagctcactgtttctgaggtcgtattcgtataaggtttctccgatacctaaaaatacaaattggtcattgtttaaccaaacaggttcaccataggggctaatctgccgcttattttgaatagtgatgctgtcaccgctgatggtccccgtcataatgcgatattgttgcccttgtaacatggttagcagcaaactacgtccatcatctgaaatggaaactgccgtaagcgaatccttttcatcaacattcttcaatggatacgttttgagggttccggaatctatgttgaatacattgaccgcagtctggtcactttttgccgtgtcaatgacaagataacaaatgtatttgctattatttgaccatgaaatatcctgtacaaaggcatccttgctagaagaaaagctggctacttcctttttgtttctgttcgtcagtgatattagatttagtgttatcttatttgatgacatcgttaatccggcgatacttttcccgtcgggagacaacttaaggttggaagtattgcggtcaatgctctgcagagtttcaggtttttcaaaaggataggagacattctgaagatgctgtgctttaccttccgttgtgtcatttcctttgaaaaaaccaactacagagtttgatgaagaccagccaagcaactggtcagcttgagggaggcgatatatcttcttcacctgaaaggagtccgacttctgatcgtcatcaatctggctctcttccttgtttggaatgataatggtttcagatcgcttgcccatattataactggatacaaaaatcaaggaaatcaataatatccctgacaatataataaaccgtttgttcttcatgatcatttctcaaccttcatgtaagcaagttcaatagtgatgattgtatggttttcttcgtagaacatcttgattgttcctccatgtttttcgacaattgttttaactatgcttaaccccaaccctaaacttccttcttccgtcaccttttggtttattgaataaaaaggctgaaacacttttgtgtattggttgtcgtcatatggatcacttggatttttgaacataaaaagaacctgatctcccgtaactttagcctgaatcatgatttctgaatgagataaactgtatttgatcgcattgtccaaaagattaataaagagttggcgcactctattcttttgaccatacacatagagactgtcttctatctcataggtgatcttctttttatatcgttctgcacgaaatttcatagattcgcatacatctttcaaaatcgttcctgcatcaatcctatcgaattgttctttagaggtttctctagatacctcaagaagttttataaccaaattgtgcagacgccggctttcttcaacaatatgattcattcctttatcaaaaaacgcctgatctgattcccctttttgttttatgatttcagcatagccttgaatagaagtcagaggtgttttcagttcatgggtcatgttgtcaaaaaaacgtttttcctgttcattaagttcctttaacctgtcccgatctttttcgatagttgaaatttgatccctaattctggtgatcatatcattgaaattaaccgtaagctggccaatttcatcttttctagaaaaatggatatccacatccagctttccctttttgacttctgaggtggcctctgtcagcttgacgattggaatcgtgatgtgtctggagagtatataagagaaaagaaacgccgccacaaatatcgcaagagcgatataaaaaataatatttaaaatctctccgctttgtttgtaaagcaaattaaaatctttagaaaaacgcaatatgccaacttttgcaccatcaatgacaactggataagaaaaaaacacctgtgcttgatttcgatcataggtgatatgataagcattttttccgttaattgcttttgctaggtcctcgtcaatgccttgcgaaaacactgttttattagaagaagacaacaaagtgccatctacggtataaacgcctacattgcttcctgttgaatgagttaaactatccactatttcatcggccatatcgccgaagtataattcattgtttttataatgattgattaaaaatgcttgattgatatacatgatactgtttttttttaagtctattaaatctgaggtcacaattttttcattgcttgaccaaatgacacttttgaccgtttgattgagcactaggaaagagagagaaaaaatcagaaaaaaaccaataataaatttacccttgatcgtccgtaacactctctactcctcctgcttctcgaatttatatccaatgccaaacactgttttaatgaggtcgcttgcatccagttttttacggagtctttggatatgagtatctaccgtacgtgtatccccggcaaaatcgtagccccaaacaaattccaacagctctgaacgtgtaaagatttttccacgatggtcaatcaatgtcttaagcagatcaaattctttaggagtcaaatcaacaatgatcccatctttttttactattctttcgtctgggatcatcacaatattttttaattgaatgtgatcctcattagacgatcctcgatcattcacgtggttagcttgttcaagacgcctgagtattgtacgaattctggcgataacttcacgcaagtcaaatggctttgtaatataatcgtcagccccaaattccaacccaaggactttatcagtgatatctgactttgcggtgatcataagtatagggatattatagcgttgggtcacttttttacagatatccaatccgctgcaatctggcagcatccaatcaagcagcagaagatcgggtttgaattggtctagctgtttcatccctaaagctccgttagattcagtacacgtttgaaaaccttcctgcgtaagcccgtatgaaagcagatctgctattgcttcatcatcttcaataataagtattttcgttttatccattatttcattcattccctgtttcatgattaaattgaatatatctatcttagagtctgcaatatcactcattatagcatcctttttaatagcggttattcagaacttcagatcaaactataattggatatattttcaccatcgtcaacaaaatcgggggaattgagctatcgttggattagaggactatggtaaacaattttaattgataaatgagcttattaaaaagagatgcgggtatcttctttatttatgtataagagcgtttccatatcgtttgattttattggggtgttaaataggtaaaacataccccgccaactgtaaccactccgcctagcagagagatcaatgtgggtatctcgccgatccagatccaagatatgatcaaggctaaagccggtgtaacataaagtgaaagggttgcttctgaagcaccgacgagtgaagtgacatatgctagtgcgaagtaaggaataaccgtcggcaataatcctaagtaaacgatagacaaagttgcgcttattgaagcgttcatcatctcttcgcctaagcctggcagaaacacaagcataggtattgttccgccccaaatggtgaatgtaacgaatggaataaaaccatatttttttatatagcgggcttgaaaaacgaaataaatactctccgaaaatgctgccagcaggatgaccaagataccgctcattgaatatgtaaagtctcccgccccaaatgcaatcaataatacacccaataaactgatcatagagccaagccatttcgtaaatccaaaatgctctttataaaacaggcgggatagcatggctgagaagatcggtgccgtagtaacgagtaagcttgcaactccggcactaactgttttttcaccgatgttcagcaaaatgtgatagagtgcaaatcctaaaaaccctaaaagaaaaatggcaggaatgtctttcaagtcgggtaggcgcatctgagtcaaaacagcaaaaagcaataatgccatagagccgattaacaaacgaaataaagcaaggtgttctggtgtgtacccttctagtcctgcgcgaattcccggaaaagcagatgcccataaacagatcatcagactgtttgaggttatcaattgaactgttttcttttgcatatttcccactcctctttacaaaaaccaaccagttatttaatgtgtttttatattaataaagatttggtgatatggcttcaaccagttaaacggattttgacccaaccaatttattttaaggagaccgattctatgagctttccagaagaaaaaaagatgaaaaagctccctaagtacagacaaatcgttcattttattaaagagaaaataggaaatggcgagtggccgattggaagcaagattccaagccagcgcacgcttgcaaaagattttcaggtaaaccggagcacagtgattacagccttagaggaattgatggccgatgggctaatagaaggcacaatggggaaaggcacagttgttatcaacaacacatggacactgatggctaagaattctgctcccgattgggatcaatatgtcacctctggcattcagatgccaagccgaaaaatcgttcaagagataaatcaatcagaatcaaatacagaccttatacagctcagtaaaggtgaactttcagctgagatttttcctttggctgttatgaaagagatgatggggagggtatctcatcacatggaggcattcggttatgaagagccaaaaggttacttacctttgagggaggcattaagcaactatttaaaaaccattggaatcaacgtctcatcttcttccattctgattgtctcaggagcgttgcaagccttgcagctgatatcaatggggctgttacaaagaggatcaaccgtttatcttgatcagccctcctacctttattcattacacgtatttcaatcagctggtatgaagctgactggacttcctatggataatgaaggacttttgcctgaaaatgttcatttaacaagaggagagcggggaagggctatcttatatacaaatccatgttttcacaatccgactggtattcttatgtctaaaaagcggcgtgaagagatcctggcagtaagtgagaatacacagcttcctattattgaagatgacatttatcgtgagttatggatcgatgaaattccgccatatcctattaaaacaattgataaaaatggacacgtactgtacataggaagtttatcgaaaacattaagcccaggtttgaggattggatggatcgtcgggccggaaccggtgattgaacgtttatctgacattaaaatgcaaacagattacggatccagttcgctatcccagagagtagcggcagagtggtttacttccggccactaccagcagcatgtagaaaaggttaggcagcaattaaaggtgagaagagaattggccttgagtgctttagaaactcatttgaaagatgtggcgacatggaatatcccaaaaggaggattttttgtctggataaaaatattgccttccatatcaatgaaattactttatactaaagccttatcaaaagggattctgctcaatctcggcagtatctatgctcaggaaaaagggaattatattcgcttatcatatgcttatgcatctcttgaagaccttcaaaaggggatttatgagttgggtttaatgattaaagaattggcaagcaggtaacttttatatccttaaatggatgtttcactaaaaaagagatcaagcctaatgatcgcttgatctgataataacaagggttactagaatagaccaaatcatggttcggtcttaaaatgatcatgtctctgaacgaaaggtctttccgacttctcttcctaaaccaaagtagtgtctgaaattatagataagcgggctccatttagaggggttgatatggttttcatccagtataatactttcatcggcatgaaagtgcagtgcctgcgtctctacaatggcaaatgactggtcatattctggaatccgaatatgtttcacttcggcttcgatttggatagggcattctttaattcgtgttggtgatactgtttttgattgtaaaggcgttaaccctgctgcctcgtatttttcttttttatatgtaaatccgagctgcttctttaaaggcggtatactcttttttccgctataagatgaaattctttcaacgttttcccataattccgggccaggcaagtttatgacacattctttgtgtctttccaaattgtcgatggcttttcctcccagtcctactccaaggattatataatgtccaagagcccaagaagatgacataggactaatattagtggttccatcctcattcaatgtggttagaagaaatgtcgaggtaccataatacatgatcttgggtttgatttccttaaatcgacgagtgtcttgttttttgatgtccaacgttttttcctccttgtcacgcttacatttatattgtaaaggattaacatttcaactatcatcgaaatatgaatgtaaggaggaaaatcatgaatcctaatattgcaaaaatctcttcgttgctatcagatccctcgcgttcttccattcttctcagtctgatggatggcaggatacaccctgcgggagagcttgcatatctcgctaacattaaacctcaaaccgccagttttcacctgaataaattgcttgaagcaaagctgattagcgtagagaagcatgggagacatcggtattacagattgtctgactcagatgctgcaaatgtgatcgaacaattgcttcatattgcgcctaaagcaaaagtcaaatctttaaaagagtcaaaagagaaaaaggacttgcatttcgcccgtacctgttatgatcatttggcaggttatgtgggcgtgcaaatggcacattcattagttgagcaggggatgttaaaaaagttgatttaaactttgaggtgacttcagagggtgctttattcttttcaaagttaggcatcaatgaagagcaacaacggaataagaggagagcctttgcccgctgctgtttggattggagtgaacggcagcatcatattgcaggagcattaggaaacgccctattggtgcgcatgttagaagaagagtggatcgttcgtatgcctaaaacgagagcgattaggattacacaaagcgggaaaatcgcgtttgaaaagcacctaaacgtgaagatttaggatgttgaagcgaaggcacgatatccaggagtaggagtaagatttgttctaatcttactccttcttcttattttgaagcatctcgattccccattgcaatcgagatgcggttccaactgtttatttgattaatgatcagaacaaggtcaacatattgtttctcatcataatgttcccgcacccgatgatatagctcatcaggaacccttttagatggaatgagcgtgatgtgttcagatagttcgagagccgctttctcttcaggtgagtaaaaatcacattcattccaagcatgtaaacagtaaattcgctgttcagtttctcccattttgcgggcatcggacgtatgcatatctatgcagaaggcacagccgttcatttgagagactctgattttgattagttctctcgtcgttcggttaattgaggattgtttcgtgtatttctccatatccatcatgattttcataccttcaggtgcaatctcatagtaggacactctttgactcataaggcaagactcctttccatagaatacctagattgtatcccggtattgatcattttaccaatgtgcggtttgaatgacagctgtatcaccgtcttttggaaagaagtttctttgaataaaaataagggtagccagcaatgatgagtggagctgctaatgcaagcagtatccatgagcctgattggctgtctctagtgactctaatgaatatataagtaccgatcagaaaatataataaagcacctagaaaccaatacatgttcaatcctctttttccttgctttttggttgcgcatttttgtctgtcatatggcttaatcgatcagggttctgattttttaataccttctcagtccggattccttttctctttaatgataaaattgtgagatcaatcgatttcaatgatgatcattccttcaatgaatagtaagttccttatgattttaaaggtaaatttgaaaagataaaacgtacatagaggcagaacgttcatgtacgtttgggcaatgatcacttattggaaactctaatgtttccctgcacctgatattgttgtgttccttctcttcctataaaatgattggatacatgtatgtttgcacgttgaaatatgggttcgattttcatgaatctctattcggtgaaacaggtaaaggaagtggataaggtttgcttataaggaatcctttcaaagataaatattactcacatgataggcgggcattaaacatgcttgcactcagagtgccgggcctggcttttattctcatgatctatatagcctctatcgtgctgcaatttgtttctggggctggtccattttattgctttatgcgtttaccatattaatcgccatttttgctttgcttcattggcactcatatcgctgggttaagaaaagagtgattctgtatttcgcggtacaaggtttgatcacctttgcacttgctaatctcatgactggcttctttatacttgtgattatcggcctttatgcatttttaattggacaaattataggaatggcagacagaagaaggacttttctcattctttatctattgctgctgctggtcataaattcggcgtatcaccttcataaaggtgaagttttgcattttattgttattgctgcgccgatcatgattgtcatcatcacttatgccgcaacattttttgcccaagtcgatgaaaaaataaaagctcaattgactcttgaaaggctggagctggctcatcagcaggtagaacagctgacgctgcagaacgaaagacagcggatggcccgagacttacacgatacgcttgctcaaggtcttgtcagtttaaatatgcagctggatgcgattcatgtttatctcgccaaaggcaacacagagagagcgaaggaaatcatacaacaatcgatgaaaagagtaaaaagcacattagctgatgcacgttcagctattgacgatctccgcagcaaatcagaagaaatcggtgttttaaaagaaagaattacctcgctaatggatcattttatagagtcgacaggcatggcttgtttattagattacagattgcaccaggtgctggatgtgcgtacagctgaaaactgttattacatcattggagaatgcatgacgaatgcggcaaagcatgctgaggcgaaaacaatctggatatccatttgggatgatgaaaagggaaggctccatttaacagttaaggataacggcaagggatttgatgttgaaaaaggaaagaaaaagagaggacattatgggcttcttggcatacaagaacgtgtcagggcaataaatggccaattcaatatcaagagtacaaaattgaaaggaacacaaattgagatcactgtaccaattcagggagagatgcaagatgaataaggttttaatcgttgatgaccatcttgtcgtgagggaaggtctgaagcttttaattgaaacgaatgatcaatacaccattataggagaggcggaaaatggaaaagtcgcagtccgtcttgcagatgaattagaaccggatatcattctgatggatttgtatatgccggagatgagcgggttagaggccattaaacaaataaaagaaaaacacgatacccccatcattattttgactacatataatgaagatcacttaatgatcgaaggaattgaattaggagcgaaaggatatctgttaaaggatacgagttcagaaaccctttttcacacaatggatgcagcgatcagaggaaatgtgctgttgcagcctgatatcctcaaacgtttgcaagaaatccaatttgagcggatgaaaaagcagcgcaatgagacgcagctgacagaaaaggaagtcattgttctaaaagcaattgctaaaggtcttaaaagcaaagcgattgcctttgatttgggcgtctctgagcgaacagtaaagtccagattaacgtccatttacaataaattaggcgcgaattcaagaactgaggcagtaacgattgccatgcaaaaaggtattctgacaatagacaactaaactgcatatttgaaaattgcccaaacgtacatgcccgaatgtacgtttttttcatttcattgtcaactacaatgagaaagaatgtgatcaagcaatgtgttggaaggagattatcatgtcaaaaatgttatatacattaggaggatgggttgctcgcaatcgcataaaagcaatatgtgcgtggatcgttgtgttagttgctgcgataggccttgcagtcaccttgaaaccaaatttttctgaggatatgtccatacctgacacaccttcggaaaaagcgatggatgtgattcagaaagaatttcctcacggtcctgataaagggagcatacgggttattttcggtgctggtgatggggagaaacttactgggaagccagcaaaaaaagcaatagaagatacgctcaaagaaatcagtaaagatgattctgttgactcgattgcaagtccttttgtgacagggacaatcgcgaaagatggcacagttgcctatgctgatatcaagtataaatcatcagcagatgatataaaggattactctatcaaacacttaaaagacagtttgaaaatggctgatgatgaaggattgcaaactgagctaagcggagatgtaccgggagccgagatggagataggcggtgtctctgaaattgtcggcattatcttggcttttgtcgttttagccattacattcggttctttattaatagcaggtttgccgattttaactgcactgattggtttaggtgtaagtattggactggttttgattgggacacaagtatttgatattgcttccgtcagtctttcattagccggaatgattggccttgctgttggtattgattatgctttatttatttttatgaaacaccgccagtttttaggcgaaggcatacaaaagaatgaatcaattgcgagagccgtgggaacagcgggaagcgcagtcgtttttgccggacttactgttatcgttgcactttgcggattgactgttgttaacattccttttatgtctgcgatggggctgacagcagggcttagtgtactgatggctgttttggcttccattacacttgtgcctgcggtcttatcgattgcagggaagcggatgattccgaaatcaaacaagaaaatagaaaaacaaagcactgaaacaaatgtctggggacgctttgtcaccaaaaatcctatcatgctaagtgtatgcagcattctgattttgatcgtcattagtatcccatctatgcatttggaactgggcttgcctgatgctgggatgaaagctaaggataatccggatcgccgggcatatgacttgcttgccgaaggctttggagaaggatttaatggccaattaacaatcgtagcggatgccacaaatgctacagaaaataaggcggaggctttcgcagatgcagtgaaagaagtaaagggcttagaccatgtagcaagtgtcacccctgcaatgcctaataaagaagggaactttgccatcattactgtcgttccggaaacaggtccaaatgatgtcacaacgaaagatttggtacacgatgtacgcagtttgtcagataaaaacggagtagatttgcttgttactggatcgactgcagtgaatattgacatttcaaatcgattgaatgatgcgataccggtgtttgctgtacttattgttggctttgcgtttgtattgctgaccatcgttttccgttcgctgcttgtgccgcttgttgctgttgcaggtttcattttaacgatgacagccactcttgggatctgtgtatttgtcttacaagacggcaatctcatcgattttttcaaaatacctgaaaaaggaccgatactcgccttcctgccgattttatcgattgggattctgttcggtttagctatggattatcaagtatttcttgtcagcagaatgcgtgaagaatatgtaaaaacaaagaatccagtacaagccattcaggctggattaaaacacagtggtcctgttgttacagcagccggcttgatcatgattttcgtttttgcaggatttatctttgccggcgaagcttctattaaagccaacggattagctctttcctttggtgtgctctttgatgcctttattgtaagaatgacactgattccaagtgtcatgaagctgatggggaatgcagcctggtatttgccgaaatggctggacaagatgattccgaacgtggatatagaagggcatcaactgacaaaggaaatacagccagaaatagatcatgaacaaaagaagcaaatcatgtaatagaaaaagcagatcttttatgatctgcttttttgttaaatagttaaagtaatagcattaaaaccgcaatccaaatgcatgaatcacaaaaatcacaacaggagggatcaggagggaaggcagcaaattcaatgttttgaacttcttgattccaagaatgcttagacctgaactgaggatgagtatgcctcccacaattgtgatttcattaataaggtctgtattgattgcgctctccattactctagcaaataaatagatggagccctgccaggcaaataatacaatggcggcagccgctattccaaaaccaaaagttgatgcgagcacaatggaggtgatcccatctaacatcccgtttgtcaggaggtatgtataatctccatgcaaagcggcttcaacagggcccaatattgacagcgaacctatacaaaataataagaccgcagtagataagccctctgctaaattgcttttagaaaatttgttcaccagcttgttgaatcgtaattctaaattgatgatctggcctagcaaacctccaatggctaaactcacaatgaatagaatggggtatttactatcaggcaaatgctgtgtaatggcgttgatccccagcgcgactgcagcgaatcccattgcctgcatcaaaatatcctggtattcatctttaatgccttttttgaatatccccccgattatgcttcctgcaatgatcatcactgtgttaaaaatcgttccaaacataagctttctcctccaaaaatcattcctgcataaaaaataaaccctctagttagtagagagtcaagggagatcaaaacatattcatgagattatttgatgggcagcaggatttcagtcacataattgtctaggttattcgtaatgccataatcaatgagtgtgatttcgattgaatcccctgctacctcataatgatgttcttccatatacgccagtaatgttttgtagtatggttcggcttcgaggtgtgaccctctaaacctaatttgcagatattctcttgaagggaaaatgatttctgatgaagttttttcattttcatcttctagaatcataaatatactggaatatttgtcaaactgttttgccctcacatttgctgcagaaatggataaaccgatcttgcctatgaatatatcttcgtttacattcaggtgggttctcaattcagctaacgaatgttcgatatcatggcctagaacatattcatgctgcaagtaagccacacgcattgcgggaagtttgatttttgaaatttgatgtaacggcatgttaacggcatcttctatatgtgtgatgcgccgggagatctttcgttcaatgcgttccaattctttcttcttgcgatcaatttcagcctgctggctttttagtaaatgaagaagagtgtttgtattttgagagttataaaaatcaagaagcttattgattggcaggcctagggccctcaaatacttgatggtatcaagccgctcaaactgttgggtagaataatatctatagttcgtttgctcatctttatattccggtttcaaaaggccgatgtcatcataataccgaagagcagagattttcacattgaataactttgacacttctccaatcgaaaaaaattccttcattctaacaacctttctgtccctatgattgatatacacacattatatagtacggcgagtactaaaggtaaagtttgcagcataaagaaaaaactccttctaaaaaggagcttttcattcttcgaaataaggatttacatggataagcacttcttctacatctgaaaactgtcttttgatttcatttcgaatttcgcgggcgatgtcgtgtccctgcttaattgtcaaatcatgatccaaagataaacggacatcaagcaatttatagtggccatgttctcgcgcgcggattctatcaattcgttttacttgatcacattgaaaaataacagctttatattcctctatcagctcggggtcaacactcttttccatgagcacatcaacagacggcctgattaattccattgaaatcttaaaaatgaggtaagcaacgattgcactggcaatggcatcggcgtacaacagataggaccatccgcgggtgtttccgatgatagccaacaggacgccgataaaagcggcaagagaggcaacgatatcgcctttgtgatcgtacgcaatcgctataattgctttgctgttccatttttccccttgctttatagaataacgatataagatttccttagccacgtacgaaatcagagccgcaaacaatgcgctgtattggggaacgcttggccctttaacaaaggacagaatcgcttctatgaggatataaacggatacgatcactaagataattcctacaatcgcctcactaatgacttcagcttttccgtgaccaaaaggatggtcttgatcgggcggtttattggaaatgccgatcactgccaagactgcaatcgaagcaacgacatctgccgcggaatgtattccgtctgcaaacacggcttcactatcgcctaccagcccaaaaaagacctttcctgccattaagatcagattggcgatcaatgcaatcaaagcaacttttctgcttatttgttctctttcacttgccatttttccctcctataaaactgcacaaaaaaataggagtgctctatatacgctctccgtatcctttcctgtgtaatcactttgcttatcataccaattcaattccgagtgggtctatagcaacgttgtttcctgtttactaataaataaggtgacagaaaaaaagttggatctatgctaaaaggtcataaagcaaacaaatgagttcttatgtaacaacagtgatgattcgctattaaaatgctgccgtcagtgaaaaattcccactaattttcaaaaacctattgacatgagaagatctgtattttactattatctcatattcaagatattttaatttgagatatttagtcgaaaagatcagcgatcaagcgcaactctaagtgttcaatccgttgtcatttcttttacacaatattcaatatggattttttataatataatatctcgaattcgagataaaagggagtgtatcataatggctgaatttatacagttagtcaatgaaagacgatctgcaagcaattttctttcaggtcatccaatcacaaaagaagacctcaatgaaatatttgagttggttgcattggcgccatcggcttttaatttgcagcatacaaaatatgtgacggttcttgaccaggacgtaaaagaaaagctgaagcaggccgcaaacggacaatttaaagtggttagctcttctgcggttctcttggtattaggggataagcaggcatatcaacaagcggctgatatctatgaaggtttaaaggtattggggatattaaataagcaagagtatgaccacatggtgcacgacactgtttcgttttatgaaaacagggggagaacaatttaagagagatgaggcgataaggaatgcttcactttctgcgatgatgtttatgctgagtgctaaggaaaaaggctgggatacctgcccgatgatcggctttgatgcggaagccgtaaaacggattttgaatatagacgaccaatttgaggttgtcatgatgattacgattggaaaagaaaaaacagagagcagaagaccacgcggctaccggaagcctgtgaatgagtttgttgagtatatgtaaaaggagcggataaaaatggctaaaaaaacgatgggaattcatcatattacagcgattgtcggtcaccctcaagagaacacagatttctacgcaggagtgcttgggcttcgtttggtcaagcaaactgtcaattttgatgacccaggtacgtatcatctttattttgggaatgaaggcgggaagcctggaacaatcattaccttctttccgtgggccggagcccgccaaggcgtcattggagacggtcaagttggtgtgacttcgtatgtcgtgccgaaaggggctatggcattttgggaaaagagactagaaaagttcaacgttccatacaccaaaatcgagcgctttggggaacaatatgtagaatttgatgatcctcatggactgcacttagaaatcgtggaaagagaagaaggagaggctaatacgtggactttcggagaagtaacgcccgatgttgccattaaaggttttgggggtgcaaccctattatcagcgcagcctgacaaaaccgctgaccttttagaaaacatcatggggctggagcgagtcggcaaagaaggggacttcgttcgttatcgttccgccggtgatatcggaaatgtgattgaccttaagttaacgcctattggccgcgggcaaatgggggccggaacggtgcatcacatcgcttggcgggctaacgatgatgaagatcagttagattggcaaagatatattgcttcccacggatatggtgtaactcctgttcgggatagaaactattttaatgccatttacttcagggaacatggggaaatcctgtttgaaatcgcaactgatccccgggctttgcacatgatgaaacacaggatacaatgggcgaaaaactgatgctgcctgtgcaatatgaaccgcatcgcacacaaattgaacaagggctgctgccgtttgaagtaagagagttagattgatttgacacataaaaaataaagaaacatataacatatattcaattgatgattgctggataccgtcagcaaagaattagataaaatcaaagatgaggagagatacaaatggaagatgcaggactgttgcttattcgtataatgattggtgtggtgtttttgttttatggcacacaaaaattattcggctggtttggcggatacgggattaaaggaaccggacaatggttcgagtcaattggggtgaaaccaggaaacgttgcggccgctctatcaggtcttggggagttagtaagcggaattctatttattttaggcgtattcctcccgcttggagctgctatcataacaatcattatgttaggtgccatcgtaaaagtccatggagcgaaaggttttgcgaatggcgcgggaggttttgaatataacctggtgctcattgcagtttccgtaggggttgcactcatcggttcaggagcttacgctttgcatttttaataagaaagtatgtaagaacagttgctgcttgtcagtaactgttcttttgtttttacattttccggaaagattgcaggtactctgcaaggcaaaaaagctgatatcataaataaaaatctgtatagtgaatgatacgtattgatgagcttggtcatgaaaaacagacctatttgaaggagtaaatggatgaaagagatgacagaattacattcattagattctatagaaaattttatcaaacagcacaaattcagttttatttatatatcaaggcctggctgtacagtatgtcacgcagttctgccccagctcagaatggtattggatcagtttccaaacatcaaattggcgcatatcaatgctgacgatgtagcagaggtcgccggccgattttcagttttcaccgttcctgtgcttcttttgttcattgatgggactgagtttctaagagaagcccgttttgttcattttgaacagcttgaacaaaagctgaaaagggtttatcgattatatgaaggcgaataaagaaataaggcaaaaaaaagaactcaaatgagttctttttttttgcatcaatttattcttcactaggcgaagaagggttatcaacctgcccttgatcacttgtatcattatcacaacttgctgaaataataattgaatgagaaggagaataatctcctaatgtgaaattgactccgtaatttttgctgttcgcagtatggctgttttgcaagttttgtccgatatctgtattggcgttttgtgtcattccatttatcgtgagatttgagatgttgatttgagatcgcatgcttcaaaaactccttccactcagaagtagtcgtcatagaggacgctggcagtctatttacttctatgatattgcgttttttatatcattgcatcaacataatggtaaaaataatagcgagtgaatgagtctcttttgaaggtgatcaacctatcagcagaattaaagccgcctgataaagaggcggcagatcgttatatgtcatctatgaatttgatgtatcgtttttcgtttgcctaaaggataagatggtcgtttttaatgatgagtaggagcctatagcagcgtagccataaaaccagcccataaatacgccagaaaagaggctgtgtcgatggcttatgaaaacagaaatgacaaggcctgttattaaggcaactgatggtacaaaagttttggggattttcaataatattttgaggatttgggttatcagtatgatgattggaacagctatcacagcatcccaaaagtttgtgtgaataattggaaaatccatacggcacctcatgaagtgttcatttcttatgtttacgctaaaagcttggaaagcagttcttggaacgcatttgtaacatgtagggcttgattggcggagcttgtttggcttaaagcattggattcaaaaaccaaacctgtattattccctccggaaccatctgtctctttagaaacagagaaagggctgatggagaatgcaaaaccgttattaaaaatgctgtttccggatatcgaatgaatatatactgggaatttcatcattcatctctcctctctgttatgactgtttatacaatatggtgtgtgagcagcaattgcttaaacaaaacggcaaaaacattcagcgagagacaaaaacctgcaaaattccacaagtgcctgttaatgcagtttttttgggatgttttttttattctttttaccaatttcatcaaaaatattctgattgctagacaaatgggcttgtccgtccttatttatgaaatccgggtgaatgagttttttcagatccctgactgttaagggtttggcgtcatcagttaattctattcctaattgcccgtttgcctctaatgtcgcaattttgacatcttgtatagccgtaacgccgtgaagccttagatgcatttcaagttgatcaactgtaagtctcatcttctttaagttttcgatatgaagctgtccgttttcaataacaacttttgcttttccggtcaacatcttttcaatgaagttcgatctcatttggatccattctattacgatgagtgttattgtgaaaattgccgccgcaattaatgttttgaagaggctgtacttgatgattggctgcacgataatagttccgattgaaatcatgacaaccgtttgagttgaaggcatttgtgcgattgatttcattcctgaaactctcagcaaaatgactccggctacaatgagaacaagagagattcccaagtgaaattcatgttaccacctgaccaatgatgaattagctttgtcatgggactggctttccttccgggcaatcgcaatttaatatatccgaaaggcagtttttcattctgtcctaaaccgaacaatatttttggtatagatggatatattaagccaaacaaagatagcagcaggagttttttgggcgaaacaatctgggaagcggggagcgccataagatgattgaacttgaagttgtcattagaacggttgctagctttggcttgctgttaatcgcagaacgaattttaggcaaacagacaatctctcaaatgacgatttttgattttattgcggcgatcacactaggggcgattgctgccggattagcttacaatacttcaataaaaccgcacaatatggccatttcgtttagtatttttgtgctaaccatttttctaatttcgtttctgtcgataaagaacaggaagctgaggaaattttttgccggagatccaacagtgctgattcaaaacgggaagatacttgaatcaaatatgaggaaaatgcgttacacacttgattatttaaatcagcaattacgggaaaaagaaatatttaatatcgaagaagttctttttgccattcttgaaacgaatggtcagctgactgtgttaagaaaaccgcaattccggcatgtgaccaaacaggatttaatgattgcggtaaaccaagaacacaggcttccgatagagcttattatggacggagaaatcattgagaataatttaaagcagaatcgtttgacggaatcctggcttttggaggaattgcgaaaaagagacataaaggtgaaagagaccgtgtacgcagtgctgctgggtaatggggatatttatgtggatcaatataaagaccatatatcagtccctatggataaggaatgaaggtacaatcaatcttaaagccccttattgaacgcaatggtttcaacttgtcttgggtacgaaatgtgcagaagcccgtttaacagctgaatctgtaacaaatgagattcagtggcctcgggaagctgaatgattcgctcaatttctccgtaataccgttcacgaagcacttccatttcggctggaaaaacaggcgtgatcgttcctttgatcagcagctgggttttagatagtaagcggatcgttaattcttcctcatacacaccgggcatttccacaatgataaaattatcttcttcatcttgataaaagtcgtaaacgagcgtataggtgttggtattaaaaaattgttccggggctttatacttgagcacatttgtccaaaagtcattttgcttatattcatttgtaatctcaagccactttctcattttttcgagatccatctaggatcctccttaaatttggtttgaaatcggtgcagaagggtttccaatttggtcttgatcactgatatcagtatcgaggttcccagtatttaaaagagaagaagaaggcgaaaaatcccctagagaaaagtttgccccaaagtatttgctgttcgctgtatggctgttgtgtacggttggaccgacatcaatatttccgttttgtgtgacgccgttcaccttaatatttgcgatgttaatttggtatggcatagcgaaactccttttaatctaaaattggcggtactggaagcggaggagcattcatattggtagtatcagagtttccgagttctgtctgatcgttgacatcaggatcatttaagaagttttccatgattgattctgcaggtgatgtatcaccgaaagaggagttgatcccttgggatttattatttgcggtatggctgttatgcgcggcttcacctattgtaattgaaccattgcccgaaatactgttgatctttaaataatataggttgattattgtagacggcatcccatcacacccttccatcattctgtacagtacattatgcgttgctgcacccaattgttccttgcatttgcgggcaaaactctatctggccctggagtgatgctcgttagaaaaaagaataaaatttgtcacagcctgaatgtcaatctatttggtaaatacttatcagttgaatgaaaagccattgaatatagtaatcaatgaattgattcagttattcgaaatacatgagaccctttaataaaggaagctggcaaacaggatcagtttgaaatcattgacaatgaagctaatgccatgaaataatactcgtgagtaacattacttgcgagtattatttttggggtggtcctcgttgaaaagcaaaaaaggacgtaaaggagaagaaagccggaaacggttactcaaagctgccgctaatgaattttcgattcggggattccatgacgcgaaggtaagtgaaattgtgaaaaaagctgggttcacgcagccttcattttacctgtactttcaaagcaaagaagccatctttgccgagttaataaccgattttcactctcgagtcagaaagctgacagagtcacttcttctggaaaacggattaaacacggaggatgtatcaaaacgggtactgctagctgtagagactgtttttcaatttttggctgaggacaaggatttaaccaagatcggcttttttctcaacccggaagcaaaacaaatgaaaaaagacttggcgatggttttgaaagagaacttagaagcagaacagcggcttggctattttcactctgaactggatatggaaactgtcgctgagtgtttggtcggcatgattgaacatttaaccgattcatttttgttaaccggaatcaaagatccggcaagcctcgcagcagagattgtgaatcttttaatatacgggatgcttccgaaagggaatgacgtaagatgatatctattattatgaaagtcagtttggcagtttttatgtttgcgggaggcatcataaaggtaagccgtgttccctttcaagttgagcattggcggcattatcaatatccattatggtttctgactgttaccggcattcttgaaatagccggggcacttgctatgacagcgggaatttggaatcggtatgcagcgattggagcaggtgttctgtttgtcgttctcatgacgggagccattcatgcgcatatgtttcgagcaagacaatcggtcatcatgacgataccagcgatgatctgtttgattgtttctatcatgatcatcatggggagttacacgtaagcttttcactaatgtttaagaacaagcccatttgcaggaaatctcctgttcttatcgaataatagaaagtccaggaattaactgaagcagtaaaatagagctccatttctgcgttattcgtccggcatcagctgggctttttttataaaggaggaatacaggatggcattcactttggaagacatgactgaggaagagttcgaagcctttcgagtgatgtccgtgcaaaattatgcgaaacaaaacataacgtcaggaacttggacggaaaaagaggcgtttgagaaatcggagcaggcatatgagaacatgattccgaatgggcgagacagcagcaatcattatttttggaacatcacaaatgaccaacgagaaagaatgggctggctctggctgtatgctgatccgtttcatccgcaaaaggaagcgtttatctattcctttggattgtataaagcctttcgcggaaaagggctggctcaattggcgcttcaaacgcttgatgaaaaagcaagagagcttggtgcggaaaggctggctctacatgtatttgcacacaacgagacagccgtctatctttatcagaagatgggctatgccatgaccaatattcgtatgcggaaacagctgtgctgaaaagtcgcttacgttacccaaacacaagatgcctatctggaagcagtggcagggtactataagtcatcattagaaacattaaggtcatgggaaggcttgaaatataaagaaaaaaggacaacagctgttgtccttttcaatgccgcttgaactttctccctcagtcttttttgtcttgatgatccagctcttttattcgtttcgtaagctcattgaaagcctgatcaagctccttataccctttatcatttggcgtcataaaactgagttttcccagcacttcttgtctttctgtctcaagctttaatcgaagctcttcccgctcatttctttctgaaggagcggcgtcatttaactgcttttcgatgccgttgtttgagatgacgagtttactgtttgttgttttttcgagaaagtatcggtcatgtgataccgccagcaatgtgccgctgtattgtgatagtgtttcttccagctgttcgcgtgacggcaggtcgagatggtttgtcggctcatctaaaatcagcacgtctttttcctccagaatataggccatcagcttgatctttacacgctcacccatactcatatgcttgatcggttcagtccattgggcagctgtaaaacctaagtgcctcatcagattttgaacgtgcccccttgctttgaatgtttcattcttaaataactcttccggtgtttgttctaaaggcaaatcaaacacctcctgcgttaaatagccgatgtttgctgacggcgacacccatacgcttccttctgctgtttcctgtcccagaatgatgttcagtaatgtcgtttttccgctgccattggggcctatgatcgcaaccttttcgccgtgctgaatcgtaaagtttgcgttcttaaagaggatcctttctccaaacgcttttgttacattctgaacttctaaaaaacgttttcctgttttgtgggttgtatcgattgaaaagcggactgtatattctggggtaacgggttccgcctttgctttttccagctctttttcaagccgcttctgcttggattttatctgggcatccgtacgcttcgcttttacccggtgatattctttaaacccttcctttttcgtcgattgagcatgggctttttccgaccaagaagcgagctcattcatttgtgcttcaatccgttcaaccattttttgctgcttttcatattcacgctgctgggtgagtcttttcttctcccggaacttcatatacccggagtaattccctttgaattcaatcagcgtctgatcctcaagcgaccatatttttgttgcggcttcgtctaaaaaatatcgatcgtgagaaacgagaatcacagtgccgctataatgtttcagctgttggatgagaaattgcaagcttttttcatcaaggtggtttgtcggttcatctaacagcagcagatctgcatcctctgatagtcctttcgccagccgcgctttcagtttttcaccgccgcttaactgatgaaaatcacgaagaggcacatgccatttctccagtaacttcttttcggcaggtgtctgatccgcaaaggaatacgccgcggtttcctgttcaaccaaagccagttttatatccttccgaaggatttgaccctgtgcaggggctaagtcattgtgaatgaggtgcagcagcgtagatttcccagcgccgttttttccgataatcccaatgatatctccttgctgaacactggcgtttacatgtttaaaaacagtttgatcctttacttcatagctaacgtttgttaatgttacgatctctttcatccatatccctcgctttaaagggagaataaaaaaatcctcccaaatgtgttggaaggattagccgtgcctgtgcatgatcaaataagctattttttataaatagcagtgtcgtatatatagaaaatgggcagactaatcctattttttgatttgaaatattgatttcaaacggtaaaaataagattagttaatcattgtccacccatcatcccttcttgttttgattacaaacactatagcatatcttcaaattcaaaagcaaaggtcattttcatcaaaaaaacccctgctctcatttttgaggcaggagtttcgagtgttattgatgcttcgcttttctcactttataaatcacaatcagcaaaataaaccaaaccggtgtgacaaataaggaaacacgagtgtcctgtgccagtgccagcacaaccagaacaaacgccaggaacgcaagaatcaggtaatttgtaaacggataaagcggaagcttaaacttgtttgttttcgctaattcaggtcttgttttgcggtatttcatatggcagatgaccgtaatccccaaatgtagataaagcatacggttgaaatgcttgtgatcagggtgaatacgccttctggcatgatgtagtttaacgtaacacctattaaaatcacgatagccgaaaagaataaagcatttctaggcactttacgctgagtcagtttcgccattgactcaggtgcattgtgatctttcgccagggaatagaccatacggcttgtactgaatacagcgctgttgcatgctgaagcagcggatgtcaacacaacaaagttgataatacttgcagccccgacgatgccaacagcgacaaatacttgtacgaatgggctttcgctgggattgatgacatcccaaggatagatgctcataatcacgagaagagccccgatataaaaaagcagcacacggacaggaatattgttgatcgccttagggattactttttcagggttttctgtttcaccggccgtaagcccgacaagctcaatgccgacaaaagcaaacacaaccatctggaacgagaggataaacccgtgcatgccattcgggaacaggcctccgtggctccagaggtttgtgaagctggacactcctgagcttgtggaaaagcctttgaaaatcatcacaaggccaatgacgattaacgccaaaatggcaatgactttaatcaaagcaaaccaaaattctaattctccaaaaagcttgactgtcgctaggttcataatcagtaaaataataagagcgatcaagccgggcacccattgcggcacacccgggagccaatattgagtgtagagcccgactgctgtcagatcagccatcgcaatggaaatccagcagaaccaatatgtccagccggtgataaatgctgccatatcgcctaggtagtcttgtacaaaatccacaaaagagtgatagttcaagtttgataacagcagttcacccagcgatctcataattaaaaagcaaatgatccctgtgatcatataagcaaataaaatcgaaggtccggcaaaatgaatcgatttgcccgagccgagaaataagcctgtcccaatggctccgccgatggcgatgagctggatatgcctgtttttcaagcctctctgcaacgtttgctgatttatattgtctttcgtcatgtcgtctgtcactttatgtgttcctccattgaaaattgtttattgagtcagcaatctatttttaatgattattataacactaaaatttctatcttttttactaaaaaaggattgatgaaaagaattttaatgtgatttggactatttcccgaaaaaagcggctccatttagggagccgcttttttatgctttttcagtttttttcataaacaggtagagcccgtaatctgtcggtgcggatgcgtagcctgcctgccgcagcattgctgtgatattgccgcggtggtatgtcccgtggttgacaacgtggggaagcagttcggaaacagttgttttcatgattccgcttgagggattttgaatctggagtggcttattgagctgttctttttgctgtaaaaatagtatatagcgctcggataacctcagaaaaaggtcttccatttcctctatttctttagcctctgtctgttctttaagctgttcagctaaagccaaagcatcgctcaagtttttgccggaaaacacttcaatccagccgagatcagaaagataaacatgagacaatacatgggatattgacggaaacacgctttgaatttcttgatggtatacctcttttggaagctcttttaatcggttgaatatttgttgattggcccagacgttatattcatacaatttgaatgccaaatctgacatgttaaaattccccctttcgtgtgtatagcttccattatacacgaacgtgcgttcttatgtagagtgctcgtgaataaaatttgttgacatatatagtttaggggaataaactaattgacattgaacataaagtttagcggggtaaactataatgaggaggggaagatattgaatgaacaaaagctatgtcaggcgataaacctgtttgtggaagtcctgcttgaagggacagaatttgtgcatcgtgaaatcaatcaggatgtcttcaagcatatctcaagggaacaggcagacctgttgaaaattttaaaagtcaagggcccaacatctcccggcagcctggccatgtaccaaaatgtacataagagcgcgatctctaacagactgaaaaagctgctcgaaaagggattggttcaatggggcgactgtccggaaaaaagtgataggcgctctaagcttattaacattacacccagtggtgaacacatactagaagaattagattctgccatctttaacgcgctcaaaccgctgatcgatgatatagatgaggaacacttacattccatcatcgagatattcaccattttaaaaagcaaatttaaaggaggagattctgccgaatgagagcaatcatcaaattcaagtgggcaattgcagccatagtattagcacttaccgtcgttttgagtttgttttctccgaacttaacggagctggccaatcaaaaggggcaggcccagcttcccgctgatgctgtttcagaaagggcaaacgccattttaaaacaagcgggagaagaaaataattcgatcagtgttgtctttacattagacaacgctttaaagaaagaaacagagaatcagctccggataatgatcgataaaatcaaaaagatcgacggtgtagaagaggtaacatctcctctgtcagcggaaaaagaagtcaaagaccagttgatgtcgaaagacaagaaaaccgttctcatgcctgtcacgattacaggttctgataaaaaggcggaaaaaattgcggacgagatttatcaaatcgttcctgatgatttgaccgcatatattacaggagcttcccttatcaaccaggatttcgctcacagctcagaggaagggcttaagaaaacggaagtgattacagtctgcctgatcatcggtttactgttgatcgtgttccgatctgttgtgacgccttttatcccgattgtggttgtcggtttttcttatctgatcagtcaatccatactgggcatccttgtatacaatgttgattttccaatctcgacgtttacgcaaaccttcttagtcgcgatcctgttcggcattggaacagattactgcatactgcttcttacacgattccgtgaagaattggcaaacgggcatgataaaaaagaagcggcgcttatcgcttaccgcacagggggaaaaaccttatttatcagcggatttgcggtattgatcggattttccgccttaggatttgcgaagtttgcgattttccaatccgcagtaggggtagcagtcggtgtgggaattttaatgatcatcctctacacactgctaccattatttatggtgacgctgggtgaaaaattattctggccttctaagaaagtgctgtcacacagtgataacaaactatgggcgtttctcggcagacactccgttgcgcgtccgtttctgttcattgtcatcacggtggtgattacgcttccgttcatcttgacctatgatgaccagatttcattcgactcaactgcggaaatcagcagcgattataaatctataaaagctctcgaggccattaaggatggattcggggaaggaaaagcgttcccgatcaatgttgtcgtaaaaggagagaaagatcttacaacagctgatacaatcccttatctcggaaacatcagcaaagcgatcgagaaagtcgatcatgttgactctgtcatgaccatcacgcagccgactggtaaaaaaatcaaagatttatatattgataaccagctaggatcggtttcagacgggctggataagacggtaaaagggattgccgatgtccaaagcggattaacggatatagaaaacggactgaatcaaatggcaggacaaaccggctcggcctcaaatggagggtctggcggttcactgggcgatgcggcagatggcttgggcaaaatcaatcagcagctgcagctcgtgagcaaacagatttcccaaaccggcaataccgcacagaccgtgcagcagcttacggcaatcagcggacagcttggccagattcaaaccggtcttgaacaagcgaaccagcagctctcaggccagcaggcacaagccggaacgctgacagaaagcctaaagaagctgtccgaaggcgtgaggagcgcaaatcagggcctgacgaaagtctctgacggtattacagcttccagtgatatgttagaggacatgagcaaaagtccaactgtaagagatacaggcatattcattcctgatcaagtaatgaaggacaaagactttaagaagtcaattgaccagtattcctttgcagacggcaaaggtgttcaattaagtgtcgttctggattcaaatccgtactcagaacaagctattgcgacaataaaccaaatcaaaaaagctgtcgcaaacgaagttgacggcactcctttggaggatgcacagatcgtatacggcggggtcacgagtatgaatgcggacttaaaggagctgtccacaacggacttctccagaacaatggtgattatgattataggcctgtttatcgtgttaaccattttgttccgctcaatgatcatgccgatttatatgatcgcgtcattgctgctgacgtactatacgtcgatatccataacagaattaatttttgtaaacggcttaggaaacgcgggtgtcagctgggcagtgccattcttcagctttgtcatcttgatcgcgttaggggtagattattcgatcttcttgctggatcgatttaaggaagaggtgcaccttggcattgagcaaggtgtcgtcaggtcaatgagcaaaatgggatctgtcattattacagctgccattatattggccggtacgttcgcggcgatgatgccttcaggtgtcaatacactgatgcaggtggcaagtgttatcatcatcgggctcttgctttacggccttgtcatacttccgctcttcatcccggcaatcattgcgacctttggagaaggaaactggtggccgttcggcaggaagaaaggaaaagagtaatcgagagaagagtgatgaatgatcatcactctttttttatgactaaacaactaacttcagacgtgttacccaaaaaaggtcagacgatcaaacggcggctttacttaaaaacaaagagcccggaaaacactcacgggctctttttttatttccattctgcaattgtatcaatcggcagacggtaggaagcatagccttcgtctgctgcttttccgatagaaagtagcataaccggtacataacgttctttatctaatccgaaggtttccgcgatgttttctttatcgtatccgccgatcgggtttgtatcgtagccatgcgcgcgtgcagtcagcatcagctgcatggaaacgagacctccgtcaatcaggatcgtttcacggttgacctgtgccggaagcttttcaaaatgtgcggtcagcgcagcgatttgtctgtctttgacctcctgcggcatgtaaccaagttccacggcttttgaatagatttcttctaagtagtctgcattgttcatgtctgcaaatacagcgatgacagcagatgatgttgtgacctgtgtttggttaaagctggcaagcggtgcgagcttttcttttccttccgggctgtcaatgacaagaaaacgccatggctgcgcgttaacagaagatggggcagttgttgcttcctctaagatctctgtcatttcttctttgctgatttttactgccggatcatagttgcgaatagaacggcggcctttcataatttccataaaatcgtttgttttgatcatgttgatacactcctcttaagcttcgatattatctatattgtttcgcatgcgcgccagcacatcaatgagcaggcggcgttcttctgcgcttacatttgcgagcatttccttcatgaaacgctccttttccttcttagaagactcaattcgctctcttccttggtctgttaaccgaacaagggtgatgcggttgtcctcaggcttgcgccgccttgataccatgcctttggcttccagctgtttcaggtgtctggtaacggctgcgctatcgatatttactttcttttgaaggtcgctttgactgatctcatctgcatgataaagcaatgtcagcaattccaaacgagattggctgatgcccgtgcatgcctcgaacttcacgccaatcaccttgttcacgccttgcagctgatataaaatctcggcttcctctgaacaaaatgacgccaaaacccatcccttctttcctgtcaaaactattaattgatatatcaatgattgacacgtcaattaatatacaacgattgatttcatcttgcaagccatttgcactctagaaaaacctcccagcgcataaaattcgctaggctagaacttagataaaaagctggccgcttcttcagatgatgctggtcacgatgattccctgcatcattcccatttataggtgttcggaatatcactttgccgagcccatgctcaagcggctttcacaggctgaaagttatgatacaatatacaaatgtttcacagcttcaatccatagttggagctgacatccattatataagggactaggttgaagggaaggtttgataacatgctgcacaatccaactggaaaagaacgcttggcactagcgtttctgctcggcatgcttgctatattgggcccgcttaatatagatatgtatttgccaagttttcctgaaatcgcggaagatttatcagcaagtgcttcacttgttcagttaagtttaacagcctgtctggtcggacttacgatcggccagctgattgtcgggccggtcagcgatgcgcagggaagacgaaaaccgctattaatctgtatttttttatttgcgttatcttctctgttttgtgcactgtcgcccaatataacaactttagtggctgcgcgttttttacagggcttcactgcttctgcagggcttgtgctgtctcgcgcaatcgtccgcgatgtgtttaccggaagagagctttctaaatttttctcgctgctaatggttattaccgcggtggcgccaatggttgcgcctatgacaggcggtgccattttgcttttgccgttcgcaacgtggcatacaatttttcacgttctcatgatcatcggatttttactagttcttctgattgcattgaggttaaaagaaacgcttccgccggaaaaacggattccaagctcaatcggaacatccgtcaaaacgatgggcagcctgctgaaggatcggtcctttatggggtacgcgttaactgtcggatttattcacgggggaagctttgcatatgtgtctggtacgccttttgtataccaggatatctacggggtgtctccgcaggtatttagtattctttttggcattaacgggctggcgattatatcgggcagctttatcatcggacgctttggcggaatcattcatgaaaaaagcctgcttcgtatagcggtcattacggctatgattgcgacggctgtgctattaaccatgaccatgattcacggtcctcttgctacattagtcatatccattttcatttacatgattacgatcggcatggttctgaccagcacgtttaccttggccatggaaaagcaggggcaccgcgccggaagtgcaagtgcgctgcttgggatgctcccgctgctcctcggttcaatcgtgtcaccgcttgtaggcattaatgagacaacagccgttccgatgggagccatcatgtttgtaacagctgtcatcggctcactggcgttttttggattaacgaaagaacgagtagggcagaattcataaaaaaacctgacatgacgtcaggttttttgttttatttagaataacaacagcaggcctgcaatcgccggagtcaaaaagatggctgatttcaaaaccacctttggcatgaggttggtgaatttcgcgcctacataggcaccgcacattgtccctaccagaactttgacaagcaaaacgtaatcaacaaaaccttctgtgatatatccgatgcctccacctacagccagagggatgatcacaagcatcgtcgttccgacagaatggcgaatggacagattcagcataatcattaaaccaatttgaataaaaggtgccgacccaatgccgaatgtgccggaaagaacgccggctacaattcctaagatgaccgctctcgtatacgttgaaagagtgctttgattcacttgagccttctcttttaaaataaataatctgattaaaatgagaattgctgataaaaataacattccagccgtcaaataatgaagcaaatcagccggaataaaagatgtcagcttggcgccgaaaaatgagccaactgcagcaaagcctccgactattaagccgattttcatttgaatgttgccctcgcgatagtggctgtatgcccctgataagcttgtaaaagccatgccggcaagtgaagtgcctaaagccgtatgaatcgggatatggaaaagaagcgttaaaagggcaatgacaaagccggctccaccggcgccaataaaacctaaaataattcctagaagaaacataacaagaataatgagcatattttttcctccattgaaaagatataaaaatgtaaacgtgcgctattctggcggaggtatggtgtcctattgacgaagaaaaacacgacgttttttcagttgccagtagtccgtcgaccgtcgttcagcaaacatatcgtacctcaaattcagggatctgacaaggcagtttgttgcttcccattaccatctgttatatgattttgatgaagaaaagcccttgaatatattcaaaagaggtattatatatggacgattttaaattagataagccgactccctactacctgcaattttataaccagctaaaaaaaatgatctttaacgggacttttaagcctggggaacggataaacgaaacacagctggcgaaaagctttggcgtcagccgctctccgataagggaagccatgcgattgcttgagaaagatggtttgttaaaagcagatgaccgaaatgggttttcgatcacgtcattaacggcaaaagatgtagatgagatttataaaatcagaattccgctggagcagctggcagtcgaattagtcatagatgaagcggacgaagaagagctgaccatactccaaaaacagcttgaagaaacagagaaggcgattcacaacggcacggaagatacggaaatcattcgtttaaaccaaaaatttcatgagctgctggttgatttcagccataacagacatttgaaaaatttgcttgagcatgtaaatgatctgattcatttttgcagaatccttaattataccggcgaccaccgtgcagaaacgatactgagtgagcaccgcaggatatttgaagaagtgaaaaagaaaaacaaagaagcagccaaacaacatgtaatggctcatttcaatcatgactgtgagcatttgaagcatgtgcttgaagaaggtaaagagaattgatttctatgatccggtaccaagggggagcagaacccttggtatttttttatgtattcaccacatatctaagaggccccgttaataagattttatgatggtttgactaacgaataatgggggttaaacatgtttatccatatcgtcgggcctggtgattctttgttttcgataggcagaagatacggtgcttctgttgatcaaatacggggtgtgaatggtttagatgaaacgaatatcgtgccggggcaggctctgcttatccctctttatgtatatacagtccagcctggagatacgcttaccgccattgcagccaaagcgtttgtgccattagagcgactgcgagccgccaatccgggcatcaacccaaatgctttacaagcgggagcaaaaataacgattccttcgatctcaaattacattgcgggaacgttaagtttttatgtgctccgaaacccagacctcgatcgagaattaatcaatgattatgcgccatactcgtcttcgatttcaattttcgaataccatattgcaccgaacggcgacattgcaaaccaattgaatgatgcggccgctattgagacaacttggcaaagacgagtcacgccgctggcaacaataacgaaccttacatcaggaggcttcagtacggagattgttcaccaagtgctaaacaatccgacagcgagaaccaatctggtcaacaacatttatgacttagtttccacaaggggatatggcggtgtcacaatcgattttgagcaggtgagcgccgcggatcgcgatcttttcactggatttttacgccagctgagagatcgacttcaggcgggagggtatgtgctgacgatagctgttcctgcaaaaacaagtgataatatcccatggctgaggggctacgattacgggggataggagcggttgtcaattatatgtttatcatggcttatgattggcatcatgccggaagtgagccgggtcctgtagcgccaattactgaaataaggagaaccattgagtttacgattgcgcaggtgccgagcagaaaaatcattatcggagtcccgctctacgggtacgactggatcataccgtaccagccgggcacagttgcttcagcgatttcaaatcaaaacgcaatcgaaagagcgatgaggtaccaagctccgatacaatattcagccgaatatcaatcaccgtttttccggtacagtgatcagcagggacggacgcatgaggtatggtttgaggatgtcagaagcatgagccggaagatgcagatcgtccgtgaatacagattgcaggctattggcgcttggcagttaacgctgggctttacaccgggcccatggcttctgcggaaattttttacgatcagaaaagtataaaaaaagacaccacagctggggtgtctttttttttgattaagtccagagcagcagaatagttcattcatttgtaccttgcatgggttgtgttcccattttacgattagtagtagtctgatcaaacaaagagtcagaatacgatttgagagggagttgtctacatgaagacagtattgattttgaattttcctgcggaaggccatgtgaatcctactttaggcattacaaaagcgttttccgataagggatatgatgtccattatatatccactgaaaaatataaaaaacgattagaagcagcgggagcaacggtccatcttcaccgggatctgctgcgaacgacacctattcatgtcggttcgcccaatggcattcttgatttcgtgaaaatccatatcaaaacgtcattggacattttacagattgtcaaagacttatctaagagcattcaatttgattttgtttattatgataaattcggcgcgggggaattggtgagggattacttagatattccaggggtctcttcatcggcgtctttcctgtttggcgaggagcacctgaaaatcctgccgctgcatccggagtctggagcgccgcttgaattggatcaagagtgcgaagatcttttggcaaaaatgaaagaaacgtacggtgttgccccgaaaaacctggttcaattcatgaacaataaaggggaattgaacgtagtgtatacaagccgttattttcagccagaaagtgatcgtttcggggatgaatgtctgtttatcgggccgagctttccaaagagagcggaaaaaacagatttcccgattgaacagctaaaagatgagaaggtcatttatatttcaatggggactgtactggatcatacagaggatttcttcaacctttgtattgatgcattttcaggctttaacggaaaagtcgtcatcgctgccggagaaaaagcggacctgaccaaattaaagcaggcgccggaaaactttatcattgctccgtatgtccctcagctggaagtgctggagcaatcggatgttttcattacacacggcggaatgaacagcgtaaacgaagggattcatttcagcgtgccactggttgtcatgcctcatgacaaggatcagccgatggtggcgcagcgtctctctgaactccatgcaggctatgtcatctctaaagatgaagtcaatgcccaaatattaaaacaggccgtagatgaggttttgcgcaacgatcagtatacggcaggcattaaaaaaatcaatcaaagcttcaaagaatgtatggacatggaagaagtgatggagcggattgatgagttgattcgccaaaaaaacaaataagaaaaagaactcccgtaccttgtacgggagttcttcatttaaaacttgattttgattttttgagcatcactggttttcttatggttatggtcaaagacgtcacttgtcgtgatttcgatccacttgatctcttttgttttcttctccgcatccgcggccttatcatgagcatggccgcttgatgcgttcacaataaagccgagatttccggacttttcggccccgccttccaattcaccgtttaactcttcaagataaatatctttgttccaatcaaaggtttcgcccgtatttgttttcatcaatgcaatcggcgcaacatttactttttttgaagaggtgttcttgatatcaacgaaaaccttaacaaaatcaaactcttcatcgtgtgttaactcatgaaagtaatcaatcatgctgtagtccgggcgcaagtggatcagcttcatttcttttactgttaactccacgtcgccaatcttataggttttgttcacttgtttgatatcttttaagacagcttttcctttatcatctgaaaacgtttggccgaccttaagcaatgaccggtcatcagttacctgggaattaggctgataattatctgtgctgtccttctgggatgaagtgctttgcggctcagcttttactgttttctccccgcctgcatgctgtttttcagtactggcgtttgatgagcagcccgcaagcatgatagcaaaaacgaaaattgaaagaattcttctcatgatgattcctccattaaaaagagatcccgttacttcatacaagcaacgggacaccttgtattcttttacttatcgttaatcttaatgttgtattgtaaagccttgaagacatttttggcgatttctgtattgtcgatttggccggcaaatgtctcactagacggaccgtatgcatagacgggaacatcttcaccggtatgtccgcctgttgtccatccagtgtgagagcgtttgttaaagatgttctcgattgcgttatcgatatccagtacttccttcgattttgccgcttcttcaacagattgaatttcggcttttgttaaagccaattttttttgatcgatatatgttttcaacgttttttcaacatccgcgccgtcagcgatcttttctgccataaagtctggtgtgcgctttgcggctttaatgggttcactgaaccaattgtagatgccgtccgcaccgatggaatatccgccggttgagtggtcagccgttgcgacaaccaatgtgtgcttgtcttttttagcgaaatcaatagccgccttataagcttgttcgaagtcttccatctcgctcatggcgccgacgatatcattgtcatggcccgcccagtcaatttggctgccttccaccatgaggaagaatccgtctttatccttgtttaatttttttatggctgtgtttgtcatgtctttaagtgatggaacatccttcgtccggtcaatctttttaggcaggccgccgtcagcgaataggccaagaacttggttgtctttgtttttcagcatgtccttgcggttatccacatagctgtatcccgcttttttgaattccttgatcaaattacggtccttacggtcaaaattgctctttcctccgcctagaaggacatcaattttgtgcttgccgttgaccatctcatcaaaataatcatccgcaattgagttcatattttttcggctgtggtcgtgtgaaccgaaagaggccggagtggcgtgtgtaatttctgaagtggccacaagtcctgttgcttttcctttttctttcgcagcttcaagcaccgttttggcttctgatccgtcgttatccaccgctatggcattattgtatgttttaattcccgcagacatagccgttgccgccgctgcagaatccgttacattttgttcaggatcatcggggtaagttgtttgctggccgacaagatactgatcaaaagccgtaggctccacaacttttgtctttttattatcctttaagtatcgataagcagacgtataagacacacccataccatcaccaatcagaacaataacattcttaatttcgtcgtggttcccctttttcttttcctgggcgctggcttcaggcacactgccgctggctaagctgctgaacgcaattgatgataaaaccgcgataggcagtaatttcttcgggaattttttcaactggataacctcctaaatatagatgaatctcaatgacaacccaattatatttttaaactgttaagctagtattaatggattttaaagattggatttacaagaataatgaactggcacccttaaataatggttattcttttatgagaagttttagaaggaaagagtgatagtactaaagaaataaattggaggaatagataatggccgtggataggcggactgaaatctgctatagtcgcatagaaacaacccgcttacatcttgaacaattaagtattatgttggaagaggtattgtgtaagcacatgtctgagcagttcatatggagtggcatcattttattttaggagggaacaacatggacgttttttctgagtatttagcggggattgatgacccgttccaccgagaaagaacggaagaggtgttaacttggataaaaaataaatatccaaatttacatacagaaataaaatggaaccaaccgatgtttacggatcacggtacatttattattggctttagtgtttctaaaaagcatttagctgtcgctcctgaaaaagtaacgatagcgcacgtagaggatgatattgtgaaggcaggatatgactacaccgagcagctgatacgtatcccttggaacggtccagttgattacacgctacttgagaaaatgattgagtttaatattcgggataaggcagactgctccactttttggcgaaaatgaaggaaaaaggcataacatatgagctgtataaaatatgttacaccttttcatttgtctatttttcgttttgatcatctattgctgcttttcttcaaacaaggtcttttcattgagcgtaagctggctcgcagaataatgattaccttgtttccatttcacttcaatcgtaatatcatggccttcaagctcatgttcatctaaccgctctaaaaaagaaacggacttttcttttgcgcttccatcagaaaaagtgcctccagcataatcatgcatcgggatttccgtgtcagaactcagcagaatttcatcatccttttttacaatcaggtccaaataagtgttgtctatttcaattgtatcaccgatccaataaagtttgctgctgtattcattcggtgcatcttcattttttttgaaaacagcttcccaattctggtctttgctttctccctgccaattcggatactccaaacgaacatgatgaatcaggtgataggaaaaaaagatcaagcagaaagcgattaataggaatgccgtgaaaatgagagggtatttataatgactggacataaaaagactcctattcgtttaatcaattaccttcgaaaatagaatttcatcccgaatcaaaatgtcgttttcagccacctcgggaatctccggcttgagtcggcgtgctttttcaactgcgttcggaaacactgcagcgaattgatagcctctcttttgataaaacgccatcgcatctacattatcattcgttgtgataagctttattcgttgacaatgtgcatatttagccgtctcttcaacctgctgaagtaaagctgtgccgattcctttattttcaatcatactatctaatgaaataatttcacaatctttcccatctatcaagtatgtaatacagccaatgatttcgccgctttcatttactgcggcaaatccatctaattcatcacaccgaaaaatgccgctggaaatcaccatctcgggtgtaccccattgcttggcaaaaaaatcggtcaacatatgtttcgctatctcattgtttgggatgatgatcatcataacactcctctattgaaagattgcatatgtactatcaatataaacaatatataacaaaaaaaatagatattgaggtgacggcatggaaatcagcgatgttatttacgggcaccaccatatagatggagtactggaagagcttatcaaaagcgctcctgtgcaaagattaaaagggatctatcaaggcggagcaagctttttagtcaatcgaaggtggaatgtgaccaggtattagcactccatcggcgtaatgctcctcatcaaaaagctcggaggaacgatagaagaacagattgcgggtctgctccacgacgtatcacacacagctttttctcatgtggtcgacgttgtctttgaaaatcaagcagaagactatcatgaaaacatctttcaacaagtcattgttcactctgaaatcccggacattttacaaaaacacggctatcatactgaagaacttttatctgacgattcaaggtggacattgctcgaacagcccgcaccggagctgtgtgctgatcggacagactatacgctgcgtgatatgtaccgatatggacacattagcctgcacgaagcgcaaacctttttggatcatcttattgtgagaaacggaaggatgtttcctgatagtattgaagctgccgaatggtttgtcagtgtgtactacaaggaagtgattgatttctttttgaatcctgtgaatgtatatggatatgaatatttagcgcgagcattgaaggcagcgctgcggcatgatgtcatatccgcagaggacctcctgaaaacggaccaagaggtactgaacatcctgcgtgcatcaaaaaatgaagaagtcctgagcttgcttacatctattcatcccggcatacaagtaatagaagatgacatccagtacgatttccatcaaaagaagaaaatgcgcctaatcgatccatccatttttcttgatggcgaatggatcaaatcctcagatgcttctgaaaaggtgaggaaaatgggtgaggccgcttatcaaaaagcaaaaaaaggtgtgtatataaaaatcttaaatcagtaaatgccgcctgacagcggccttttttcatgtttggctttgcaaacaaaggggaataggacaaactgcgggaacgctttatgagaatatcagcgtatttacataccattcgggggtatagtattatcgagagggcatgttttcattgtcttcgggcaaaagttacaggaaaaaaatgaagcaaaggagaatgaacatgaaaatctctaaaaatgcactgggaattctgatgttatctcttgttttagttttatcagcatgcggcaataacaacagtacgaaacaaagcacacatgacaatcattcagactcctcaacacatgaagagatggaccattctggatcagctgacgttccagagggattacaggaatctaaaaatccgaaatacaaagtaggcagccaggtaaccatcaatacttcccatatgaaaggcatgaaaggtgccgaagctacggtaacaggcgcctatgatacaacggcgtatgttgtttcttatactccgactaatgggggacagcgtgtggatcatcacaaatgggtgatccaagaagaaatcaaagatgctggagataaaacgttacagcccggagatcaggtgattttagaggcttctcatatgaaaggcatgaaaggagcaacagccgagatcgactcggcagaaaaaacaactgtatacatggttgactatacatcgacaacgagcggcgaaaaagtgaaaaaccacaaatgggtcacagaagatgagctttcagctaaataataaaaaatcctccttttacaaggaggatttttttgctgtttgaacaggtcttgttaaagaaatgaaagcaaacaggacagcgatgatcacaattgacccgccgcaccatgctgttgacactacagtacccgtctgatccaaaacaacaccgccaatggctgagccaagggcaattccgacttggagggccgacgtgttaaagctttgctgaatgtcagacgaatcaggtgcaatttcaattaaatagctttgctgagccggggcgaggctccagctcagaagaccccaaatcaccatgacaggcaaaaagaaaatcatagacgatgtagacagcggcagtaagaacataatgatggcaaaggaacccgtcaccagcaaaatgctcttaaaggaaccaagccggtcagatagcgctcctccgaaagggcctccgcatacagcagatatcccgaaaaggaaataacaaatgctgacccagaaagagctcaggtgaagagtctcttctaaaaacggtgcaaagtaagcgtaaagcgtgtagtggccagctaatgtaaacatcgtgacgaggtgtgaactcgcgattttcagattaccgatcgtcttgagctgttcccggaaaggaatcattttctccgccggtattctttcaaagaaaattgaaataatcagcatggagatcagcgccaacaggccgatgccaaggaacaaaatccgccacccgaaggaatcgctgattaagattccgagcggcacgcctaatgcgatagcagagctgaaacccataaaaataattccgattgcgcgggctctgtattcaggcgctacaattttcggggcaattgttaaagaaagcacaacaatcagccctgtactcattgctgccaataccctagataccatcaatgtggcgaaattagggctgaaataggcgacaagattgctaaggaagaaaacaaataaagcaattagatataagcgcttccgctcaatcttcgcagtcaatgccaaaagcagcggcccagatactgcatatcccagcgcaaacacactgatcagctgtccggctgaaacaatggaaatgtctaaatcatttgcgatctgaggaagaatcccccccacaattaactcaaccaatccgactgcaatcgtagaagctgcaagcaggaaaactttgaaattcataacaaactcctttacttaaatgttttgataaataaaaaaaatcctgattacaaaaaatgtcataaacaaattttgtaatcaggattttacggttcctggtagacaccctcaaaccatattattgaggttatacaagtgataatagctatttaattgattcgtttccgttgatgagtgtaccacattatgaatgaatcttccatagaaaaatttacaaagtgatgaaccggacaagtgtataattatatttattttataaaagtatagacatttaaaaataaatgactataataatccatgtaagcgttttaatctcaaggggggatagcagttgaaaaaaatattactcgcgtgcagctcaggaatgtctaccagtttattggtgacaaaaatgaaggaatacgcacagtctatcggtgaggaagcagagatttgggctgttggccaggataaagcaaaagaagacatgagaaaagcggatgccgttttgatcggtccgcaaatgagctttctgaaaagcgaactccaaaaagaagcggatcaatacaacattcgggttgaagtcattgacatgatggcctacggaatggcagatgggaaaaaagcgtatgagcaggcattgtccttaatggagaatcaataatggaacaggtgaaaatcacgaacttaacagacgaacaaatcagttttcagcttatcctgcacagcggcaatgcccgcagctgcatcatacaatcactgcgcgcctacaaagaagggaacaaggatgaggcggatgccctcattgccaaggctgagcaggatttatccgcggcccatgacattcactttcaaatgatacagaaggaatccggcggagaagcacaagctttctcattgctgcttatgcatgcagaggatcatctgatgtcaacattatccatgaaagaattagtgaaagagatgcttgatctctttaaaaccaagaatctataaataatcggggtggatagggtgttcgagaaaatcagccaattccttgttccaattgcagggaggttaaacaataaccgctatttgcaagtactgcgtgatgcatttatgctggctttcccgctgacgatattcgggtccatttttgtcgtgttaacgaatttgccgtttctaaacaaaatcatgaacgcctcaatgcttacgtcgtttcagtctcatttcggcattgcctccacggcgacaatgggcattatgtctgtctttgttgtgttcgggataggctattacctgtcaaaaagctatcaggtcgaagctgtatttggcggagcgatcgctttggtttcctttttgctcttaacgccatttatcattcagccagaaacaggagatgccattacaggggttatcccggtcgatcgtctcggtgcaaaagggatgtttcttgggatgattacggcatttctttctggagaaatctacagaagaatcgttcaaaaaaacctgacaatcaaaatgccagccggcgttccgcctgctgtagcaaaatcattcgccgcacttattccggcttttatcacattgaccgtatttttgctgattaacgtaatggtgactctgttttttaaaacaaatatgcacgacgtcatttatcacgcaattcaggctccgcttgtcggacttggaagcggtatcattccaacgcttattgccgtgtttttcattcaaattctttggtttttcggactgcatggacagatcattatcaactccgtgatggacccgatttggaatacactgcaggtagaaaacctttctgcttacacggcgggaaaagaaatccctcatattatttcaaaaccgtttatggagatttatacagtagggatgggcggaaccgggatgacgcttgcgattgtgtttaccattctcatattcatgaaaagcaggcagatgaagcaagtatcaaaacttggcctcgctcccggtatttttaacgtcaacgaaccgattatcttcgggcttccgattgtcatgaatccgatcattattgtgccttgggtgctggcaccgatggttgttacgctcgtcacctatctggctatgtcagcagggctcgttccgcctccgactggtgtgacagtgccgtggacggttccattattcattaatggtatcatggcgacgaactcaatcatggggggcgtgatgcagcttatcaatctgctgattgtcttcgtgatctggtttccgttcctaaaagcaatggataaattaaatctggcaaaagaaaaagaacaggctgtgcaggagacagctgctcagcaaaatgataacagcataaaaatgtgacataaggggagagagacttggtacaaacagaacaatatcgttttccaaaggatttttggtggggatcatccgcttcagcaacacaaacggagggtgccgccgacagagacggaaaaggccagaatatatgggattattggtttgaaaaagaaccgcatcgtttttttgatcatgtcggacccgcagacacatcccaattttacgacaactataaagaagatatcaggctgatgaaggagcttggccacaactcgttccggatgtcgatttcctggtcacgtttaataccaaacggaacgggcgagatcaacgataaagccgcaaatttctataacaatgtcattgatgagttgatcgctaacggaattgaaccatttgtcaatttgtttcatttcgatatgccgatggcgcttcaaaaaatcggcggctgggtcaacagagagacggttgacgcgtatgaaaactatgcgagaacgtgcttccgtttgtttggcggccgggtgaaaaaatggttcacgcataatgaaccaatcgttcccgtagaaggcggctacttatatgattttcattatccaaacaaggtcgactttaaagaggccgtccaagttggatttcatacgatgttatcaagtgcccgcgccattcaggcttacagggagatggagcaggacggaaaaatcggtatcatcttaaatttgaccccttcatacccgagaagcagccatccggcggatgtaaaagccggggaaatcgcagacgcgttttttaacagatcttttttagacccatctgtcaaaggcgaatttcccaaagagctggttgacattttgaagcatgaaggctttatgccagattacaacgctgaagatcttgacatcatcaaaaagaacacggttgacctgttgggagtgaattattaccagccgagacgtgtgaaagcgaaagaacatcttccgaatcccgacgctccttttttgcctgacaggtattttgattcctacgtcatgccgggccgcaaaatgaatccgcatcgcggctgggagatctatgaaaaaggcgtttatgatattttgattaatttaaaagaaaactacggcaacatcgagtgttttatctctgaaaacggtatgggggttgaaggtgaagagcgattcagggatgaacaaggcatcattcaagatgattaccggattgaatttataaaagagcacctcaaatggattcaccgcgccatacaggaaggctcgaacgtaaaaggctatcacttatggacgttcatggacaactggtcttggacaaatgcctataaaaaccgatacgggtttgtatcagtcaatcttgagaaagacggagaaagaaccgtcaaaaagagcggaaaatggttcaaaaaggttgctgagcaacacggtttctaggttttcctaaaggtcaagatcttccggcaatcatcataacgaatagagatgacgaaaatccgcaacattgatgaaatagggaaaagaacttatgatatccgtaaaagcttatgtgatatcagactctaacagctgccggaggatgccaatgaataaatacgaaattattgcaaatgaaatgagaaatagaattaaaaataacgtatatccgatcgatcagcccattcctgatgaagtatctcttgcaaaagaatttaactcaagccgcatgacgatgaagagagccttggataatttagttgccgagggtctgctgttcagaaaacgaggccatggcacgtttattattcaatctgcaatacaggatgaccatgtccatgtagtcagcaatgagattctcggattgaccaacttgctgaaagataaaaaaatccaaagcaaggtcattcagtttgaagtgcaatttcccactgaggaagtggccgcccatttgtctattgatcagaaaacaccggtttattatgtcgttcggctgcgaattgtagaaggtgaaccctatgtattggaaaaaacatatatgccgactcatttaataccgggcattaatgacgatgtccttcatgattcgatctacaatcatattacaaatgtgctgcagctcaaaatcgccggctcacatcggaaaatcagagcctgcaaatctgatcatattgaccagcagcatctgggctgtaaaaaggatgatccaattcttgaagttgaacatgtgggcttcttagataacggcattccatttgaatattccttttcacgtcatcggcatgacaagtttgttgtgacttctgtaaacatacggcgctgattgcggagacaacaaggaggccatctgcatgcttggcggtattgaagcaggcggcacaaagattgtttgtgctgtcggtaaggaagatggaacaatcattgaccgaatagaattccccacaaagatgccggatgaaacgatagagaaagtaattcaatattttcgccaattttcattacaggcaatcggcatcggttcctttggtcccgttgataacgataaaaccagtcaaacatacggtaccattatggccacgccgaaagcgggctggagacactacccctttttgcaaaccgttaagaacgaaatgaaaatcccagtcggatttagtacagatgtcaacgctgcggcgctgggtgaattccttttcggtgaagcgaagggtctcgacagctgcctgtatataacgattggtactggcatcggtgcgggcgcaattgtagggggcaggctccttcaggggctgtcgcacccagagatgggccatatttatatccggaggcacccggatgacgcataccaagggaagtgtccttatcatggagattgctttgaaggcttggcttccggtcccgccattgaagcgcgctggggaaaaaaagccgcggatttatcagatatagcccaagtctgggaactggaagggtactatattgcccaagcactggctcagtatattttgatccttgcacctaaaaaaatcattcttggcggcggcgtcatgcaacagaaacaagtgttttcttatatctatcaatatgtaccaaaaatcatgaacagctacttagatttttctgaattatcagatgatataagtgattatattgtacctccacgtttaggcagtaacgccggaatcatcggcacgctagttttagcgcatcaggccttacaagcagaggcagcatccggggaggtgcgatcatgacgcatccattatttttagagcctgtctttaaagaaagactatggggagggacgaagcttcgtgacgcttttggctacgcaataccctcacaaaaaacaggtgagtgctgggccgtttctgcacatgcccatggcccgtcggctgtaaagaacggcccgctggcaggaaagacactagatcaagtatggcaagatcacccagagatattcgggtttccggatggtaaggtgtttccgctgctggtaaagctgctggacgccaatatggatctctccgtgcaagtccatcctgatgatgattatgcaaaactgcatgaaaatggcgaccttggtaaaacggagtgctggtatatcattgattgcaaagatgacgccgaactgattttgggacatcacgcaagcacaaaggaggaattcaaacaacgaatagaaagcggtgattggaacgggctgctgaggcgaatcaaaatcaagcccggagatttcttttatgtgccaagcggtacactccatgctttatgtgagggaacccttgtccttgaaatccagcaaaactctgatacaacgtatcgcgtatacgattatgaccgctgtaatgaccagggccaaaaaagaactcttcatatagaaaaagccatggaagtcataacgataccgcatatcgataaagtgcatacaccggaagtgaaagaagttggtaacgccgagatcactgtttatgtgcaatcagattatttctcagtgtacaaatggaagattagcggccgagctgcttttccttcatatcaaacctatttgctggggagtgttctgagcggatcaggacgaatcataaataatggtagtcagtatgaatgcaatgcaggctcacactttgtcttgcctgcgcattttggcgagttttcaatagaaggaacatgtgaattcatgatatctcatccttaatgaatgggggagttgcatttgtttaagaaacatacgatctctttgctcattttatttttacttgcgtctgctgttttagcaaaaccaattgaagcgcatactgtgtcgcctgtgaatcctaatgcacagcagacaacaaaagcagtgatgaactggcttgcgcacctgccgaaccgaacggaaaacagagtcctttccggagcgttcggaggttacagtcatgacactttttctatggctgaggctgatagaatccgaagcgccaccgggcaatcgcctgctatttacggctgcgattatgccagaggatggcttgaaacagcaaatattgaagattcaatagatgtaagctgcaacagcgatttaatgtcgtattggaaaaatggcggaattccgcaaatcagtttgcacctggcgaaccctgcttttcagtcagggcattttaaaacaccgattacaaatgatcagtataaaaaaatactagattcttcaacagcagaaggaaagcggctaaatgccatgctcagcaaaattgctgacggacttcaagagctggagaaccaaggtgtgcctgttctgttcaggccgctgcatgaaatgaacggcgaatggttttggtggggacttacatcatataaccaaaaggataatgaaagaatctctctatataaacagctctacaagaaaatctatcattatatgaccgacacaagaggacttgatcatttgatttgggtttactctcccgacgccaaccgagattttaaaactgatttttacccgggcgcgtcttacgtggatattgtcggattagatgcgtattttcaagatgcctactcgatcaatggatacgatcagctaacaacgcttaataaaccatttgcttttacagaagtcggcccgcaaacagcaaacggcagcttcgattacagcctgttcatcaatgctataaaacaaaaatatcctaaaaccatttactttctggcatggaatgatgaatggagcccagctgtaaacaagggtgcttcggctttatatcatgacagctggacactcaataagggagaaatatggaacggcgattctttaacgccaatcgttgaatgaatcagtaatgtacaataagaaggtgctcaagaagtttcttgagcaccttcccactggattaagcattcatatcgcctaacccaggactgtgttcatttggtatttcaggaagcactggtacgggaaaccctgccggaggatctattacttgcaactctccgccatttcggcttggagatttcccttgatagatttcaccgattctcgtttcatccaacctaaagttaaactgtgcattatggtagcctaattcgacatactttctgcactcaggatatttattaatgtcataattcggtacagggaggagcttcgcccactcaacgcccaatgtctcgagcgctttcgcgaatgcattctggtgagcattgtcgcgtacaatcagaaaagcaagtgtttcgcggaacgtctgattagagctcatttcataaattcttgttttttgcagcacacctgtcgactcaagaagcaggttatccagcaggtcagtaattaagtttccgtgattatacacccacgacccgttccacggattgccccctgcatcaacaggaagggaactttgcgcaccaataatataatgatgaggattagcatgtttaacggcttcattaagtggtgcttgatctgcaccttgactgccgacaccttcaccgcctgattcatctaataaagcattgattgtgttttgaaccagttcaacgtgggcaatctcctctaaaaaaatgccgcgaagcagatcgcggtactgtttctgctttcctctgaaattagagctttggaaaaaaaactgcatcattgtacgcatttctccgtaatgaccgcctaatatctcctgcaggaccttagcagctgccgggtctggtttgtccggtttaatgatattaatcagttcctctttgtagtaatacataacacgcctcatttcttcttaagagattttcttatattatttgtaagatgagataaaatatatacatgagaagggggaaagaagagaataaaaaaatacagaaaaagtgttgaccaaataaaacaggcatggtatattattaaacgtcgctgatgaacagcgtgaaacaaaacgaaaaacaaaaaaagtttttctaaggtgtttacaagattttaaaaatgtgtataataagaaaagtcgaattgaaaaagattcgaaaaaacattttaaaaaacttcttgacttcaccatcaaatgatagtatgatagttaagtcgcttgataagcgcccgtagctcaattggatagagcgtttgactacggatcaaaaggttaggggttcgactcctctcgggcgcgccaatataagatactacgcgggtgtagtttagtggtaaaacctcagccttccaagctgatgtcgtgagttcgattctcatcacccgctccattattgaatgatctttgaaaactaaacaagacaaaacgtacctgttaattcagtttttaaaaaatcgcacagcgatgtgcgtagtcagtcaaactagggcctgcacgacgcaggtcacacaggtgtcgccgcaggaagcggtggacttaacctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccgggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcaacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcattacttttatcatcgcggggtggagcagttcggtagctcgtcgggctcataacccgaaggtcgcaggttcaaatcctgcccccgcaaccaaatatgtgattaaataaggagtgccctaagggtgcaaccaaaataatcctatacaaatatggtccggtagttcagttggttagaatgcctgcctgtcacgcaggaggtcgcgggttcgagtcccgtccggaccgccattaatgtaaacgaaacgatcatgttttcgtttttttttgtgttttcttttactatatcttctgcttggtgtcatagccaagctttctttatatcgggaacatcttggatatttcagcaaaattcgataaactaggaagagcacatataggcataagcagggttgaaaggagattttggttcatggatgaatttgatttgatacatagcattactccgcggaccattcaccattcttccgttgatgtaggaataggtgatgatgcagcgctctacactgcgaaacacggcgttcaggaaattgtttgtgttgatactatggtagaagacgtgcacttcaaattacactattcctcacctgaagatatcgggtataaggcgttagccgttaatataagtgatattgccgcgatgggaggcattccgaaattttatttggtatcacttgcggtaccttcaaaatggactgaatctgaaatcaaggcgatgtatgaaggaatgaatgaactggcgaaactatatcatatggatctgattggcggcgatacagtttctaccgctgacaaattagtcgttacagtcactgtgatcggtgaaattgaaaagggacaggcctgtttgcgcagcttagcaaaaccgaatgatattgtgtttgtaaccggtgaaatcggttcttctgcagcaggactttctttattattagaggagactcatcctcaaaattcttctattgacacggattactttatccacaggcataaacggcctgagccaagagtaagtgtcggcagattatgctcgagtcttgaacgggcagctttaaatgatgttagtgacggattggctagtgaactgaacgagattgcagaagccagctgtgtttcaattgaaattgatgaaagcatgcttccaattcattctgatttacctaagcttcatcctaactggaaagaatgggctttgtttggcggtgaggattttgagctgacagggacggtttcaaaagaggagtgggaagtgttgaagcagcagtgcgcagcacgtcaacttcccattacaaagattggccatgtcagggaaaaaacaaaatctaaagtgatcctaaaaacagatcaaacatcaatgatcttagagaaaaagggatataatcattttaaataagacgggtgactcgtgtgaagcaattaaaatggagaactgtaaatccagaagaaacaaaagcaattgccaagctgacggcatcgtttgctaaaccgggagacgtcctgacattagagggcgatttaggtgcaggaaaaacgacttttacgaaaggttttgcagaagggctgggaattacacgtattgtaaacagtccgacttttacaattataaaagaatataacgatggcgtacttcctctttatcatatggatgtgtatagaatggaagatgaaagtgaagatttgggacttgatgaatattttcacggacaaggtgtctgtctcgttgaatgggctcatttaattgaagaacagctgccgcaggagcgactgcaaattgtcatcaaaagagctggtgatgatgagcgggaaattacctttactgctgtcgggaatcggtatgaaatgctttgtgaggagttaagtagacatgacaatattagcaattgatacatcaaattatacattgggcattgcgctgcttcgagaagacactgttatagcagaatacattacatatttgaaaaagaaccactctgtaagagcgatgcctgctgttcattcattgctgaatgattgtgatatggcaccgcaggacctttctaaaattgtcgttgcaaaaggccctggttcatacacaggagtaagaataggtgtgacgttggccaaaacacttgcctggtctttagacattccaataagtgctgtatcaagtcttgagacgcttgcggcaaatggccggcattttgacggtctgatcagcccaatctttgatgctagacggggacaggtgtacacaggtctgtatcaatataaaaatggacttttagagcaagttgttccagatcaaaatgtgatgctggcagattggctggagatgctaaaagaaaagggtcgtcctgttttgtttttaggtcacgacacttctattcacaagcaaatgataaaggatgttcttagaacaaaaggattcattggaactgctgcccagcataacccgcgtccttcagaattggcttttctcgggaaggaaaaggtagcagctgatgttcatgggcttgtcccggattacttgcggctggcagaagctgaagcgaaatggattgaaagtcaaaagtagggtgataggatgaaaacaaaagcagcggtcagaaatatgcggcttgaagatatagatcacgtatacgaaatcgaagcatcctcctttacgtctccttggacgaaggattcgttttatcatgagctgctggaaaatccatatgctcattatctcgtgattgaaaaggacggccatgttgttgggtattgcgggatttggattgtgatggatgatgcccagattacaaatatagcgataaaaccagagtatcgcggccagtctttaggagaaacgctttttcgctcagctgttgaactgtgcaaagaaaaagacgcaaggcggctttcgcttgaagtgagggtttcgaatcatcctgctcaaggcttatataagaaattcgggatgcagcccggcggaataagaaagaactattatactgataacggggaagatgcgttaattatgtgggtgacgataaatgagtgagcaaaaagacatgtacgtattaggaattgaaacaagctgtgatgagactgctgcagctattgtgaaaaacgggaaagagatcatttcaaacgtagtagcctctcaaattgaaagccataagcgcttcggaggcgttgttccggaaattgcttcaagacatcatgttgaacaaatcactttggttatagaagaggcgtttcgcaaagctggcatgacgtatagtgatattgatgcgattgcagtaacagaaggtccgggactggtgggagcgcttcttatcggagtgaatgccgctaaagcattgagctttgcacataacattccgttagtaggcgttcatcatatagccggtcatatatacgcgaaccgtcttgtagaagacatcgtgttcccggcactggcattggtcgtttcaggaggccatacagaactggtttatatgaaggaacatggatcatttgaagtcattggggaaacccttgatgatgcggcaggagaagcctacgacaaagtggcgcggacgatgggattgccatatccgggtggaccgcaaattgacaagctagctgaaaaagggaatgacaatattccgcttcctcgcgcatggcttgaagaaggctcttacaacttcagctttagcggattgaagtctgcggtgatcaatacgcttcataatgcatcccaaaaagggcaagagattgctccggaagatttgtctgccagcttccaaaatagtgtgatcgatgtcttggtcaccaaaacggcgcgcgcggcaaaggaatatgatgtcaaacaggtccttttagccggaggagtagctgcaaacagaggcctcagagctgcattagaaaaggaatttgcccagcatgaagggattacgcttgtcattcctccattagctttatgcacggataatgctgcgatgattgctgctgctggtacaattgcttttgaaaaaggaattcgcggtgcgtatgatatgaatggccagcccggccttgaattgacttcttatcaaagtctcacgagataatagcgtgagactttttatctgtttgttattaacagataattcacaatttatccacatgtctgtgagtaattatagagatatagatggataaagggctgaagtcgctgttaataaagtggataaattcagaatattttgtggatattgtgtataaagcgcttactttgttttgcttattagggtatgttctgtggataaaaagcacctctaaaaagaggtgcttgacttttttaatcttcttctgtggatagttcttcccattcggacaaaagagattccagctcctgattgagcttctcattgtctgcatggatagcttgtactttttcatgatcctgatagacttcagggtcacatagcaattcatcattgcggctgatgttttcttcaatggtttgaacggtggtttcaatttcttcaatccgacggagtcgttggcgctctttctttttccattctttttcttcctcgtaggaacgtttggagtcagacttcactgtagctggcgttttatcagtttcctcttgctgattcattttctccaattcaagctgctctgtttttttctctgtataataatcgtaatctcccagatactcctctatatggcttgaagaaagctccaatactcttgtggcgattctgttaataaaatatctgtcatgtgagacaaataacagtgtgcctggataatcaatcagcgcgttttcgagaacttctttgctgtctaaatccagatggttcgtcggttcatcaaggatgagaaagttggctttttgaagcatcagcttagctagagccaatcttgctttttctcctccgctcagtgaatgaactggtttcagcacatcatctccggagaataagaaatttccgagacacgttctgatttctttttctgggagcccggggtactcgtcccacagctcatcaaggacacgtttagaggaagtcagctcagcctgttcctggtcataatagccgacactgacatttgagccgtaagaaattgttccctgatctggttttagggtgtctattaatgttttcagcaatgtcgatttacctattccgttagggccgacaagcgcagcgctttctcctcttgtgagcatgaatgacacttctgttaaaagcggcggctggttttcatagctgattgtgagatcctgaacacgaaggacttcatttccgctctgttttgtaatatcaaaatgaaagtttgcggatttttcatcgccaagcggttttgacatgacatccattcgctcaagctgctttctgcggctttgcgcccttttggtggtagaggctctcgccagatttcgatctacgaagtcctgcagctttgcaatctcgtcctgctgcttttcatacattttcagatctttttcatactgcgccgctttttggtcgagataagcgctgtagttgccgtgatactttttgctttctgctcttgatacctcgtatacctggtttactactttgtccaaaaagtagcggtcatgcgaaacgatgagaatggcgcctgaatagccttgcaaataatgttcaagccaggtaagcgtatcaatatccagatggtttgtcggctcatcgagaatgagcaaatcaggctgtgttaacagaagcttacctaaagccagtcttgttttctggcctccgctgaggctttgaacctgtgtagaatcgtcaaaatggctgaagccgagaccatgcagcacagatctaacatccgcttcatattgatagccgcctttatctttgaattcctgctgaaggcggtcgtaggttttcatgatgctttctaattcacccggggcagctgccgccattttttcttccatagcccgcatttccttttccattgcttttaagtggtcaaaaacagtcagcagctcttcttttatggtaagcttagaatccaagccagtatgctgggcgagatatcccattgtaatatctttcggtttaataatttcgcccttctcatacgaaagctggcctgcgataattttaaggagcgtggattttccggcgccatttcttcctacaatggcgatgcgatcacgatttctgacttccagctttatattgtttaaaatagtatcagcaccaaacgatttggacagctgattaatttgtaagatcatcatattatttcacctctgctataataagttaagtgtagcttatgaaccagaagtcagcaaacaatacattggccatataagacatagagaagaaaatagtgtatgatctgtttaaggagcgttttaatatgaatggattttctcattttaatgaacagggcagagcccagatggtggatattagcgaaaaatcttcgactgtccgtactgcggcggctgtttcaagcgtacacatgaagaatgaggtgtacgagaaaatacagagtcacgatatcggcaaaggagatgtactggctgtcgcacaggtggcaggcattatggccgcaaagcaaacgtcgaatatcattccgatgtgccatccgctttcattgagcggggtagatatatcgtttgactggaaaataaaagaagcagaagttatacttcatataaaagcacaggtcaaaacgaaagggagtacaggtgtggaaatggaagcgctcacttctgcatcggtgtgcgctcttaccgtttacgatatgtgcaaggcccttgataaggggatggtcatcggcactactttcttgctggagaagacaggcgggaaaaacggtgactttaaaagagaactatccgagtataatttggaggaccaaaaatgaataaggatcaatcaaaaattccgcaggcgacggcgaaacggctgccgctttactatcgctttttaaagaatctgcatgcgtcaggaaaacagcgtgtatcatccgctgaactcagtgatgccgtaaaggttgattctgccacgattcggagggatttttcctattttggagctcttggcaaaaaaggatacggatataatgtggattatttgctgtcttttttccgaaaaacgcttgatcaggatgagatgacagacgtcatcttgattggtgtcgggaacttgggaacggcatttcttcactataatttcacaaaaaacaataacacaaaaatttctatggcttttgatataaatgagagtaaaataggaactgaggtaggcggcgtgcccgtctataaccttgatgaccttgaacaacacgtaaaagatgaatcagttgccattcttacagtgccagcagttgccgcccaatccattacagacagattggtcgcattaggaatcaagggaatccttaattttacgccggcccgtttgaatgtgccggaacacattcgaattcatcatatagatttagcagttgagcttcagtcactggtttattttttgaagcattattcagttttagaggaaatcgaatagagggaaaggaggagcccaaatatgccgatcggtcctggaagccttgctgttatcgcaatcgttgctctgattatcttcggtcccaaaaagctgcctgaattggggaaagcagcgggagacacacttcgtgaattcaaaaacgctactaaaggattaacgagtgatgaagaggaaaaaaagaaagaagatcagtaagttaggatgacacgaatgaaagtgaatcaaatgtcgctgctggagcatattgctgagcttcgaaaacggttgctgattgtagcgctggcgtttgtcgttttctttattgctggattttttttagcaaagccgattattgtgtacctgcaagaaacagatgaagcgaagcagcttacgcttaacgcgttcaacctgacagacccgctttatgtgtttatgcaatttgcatttatcatcggcatagtcttgacctcgccggttattctttatcagctttgggcttttgtgagcccgggcctctatgagaaagagcgcaaagtaacgctcagctacattccgatctctattttgctgtttttagcgggcttatctttttcatattatattttatttccttttgttgttgattttatgaagcgaatttctcaggacttgaatgtcaatcaggtgatcggaattaatgaatattttcattttcttctgcagctgacgattccgtttggactgctgttccaaatgccggtcatcctcatgtttttgaccaggctcggaattgtgacaccgatgttcttggcgaaaatcagaaagtatgcgtattttacgctgctggtgatcgcagccttgattacaccgcctgagcttctgtcccatatgatggttacagtcccgcttttgattttatatgaaatcagtattctgatatcgaaggccgcctatcggaaagcgcagaaaagcagtgcagccgatcaggacgtgtcttcggggcaataataaaaaatccatttctcatgcgagaaatggattttctttatttctgattctttttgattttaaatgaaaaggcgaacatcttaaaagaaatgctgatgttgtaagcggcgaacaccatcagcaggatggagtaaaatgaccacatgctgcctggcgagcttgcggcaagataagtaaagatgcatcctacggcaaagtagatcattccccaaactaccgggtttctcataaaaataatcctccaataatcaattgcatttgtgtgctctgctgttcaaggtaattccgaacaggctcaagctgcatgatgacgacgaatgtattcatcattaaatgggcgaaaatcggcacccatatccgttttgttctcgcatataaaaatgcaaaggtaaagcccattgctgtatatagaagaagatgcttcaaatcagcgtgaacaataccgaaaataaccgagctgatcagacctgcgaaaaagaaattcgttttttcgtacagcgcgccgaaaatgatttttctgaagatgatttcttctaatataggcccgacgatggaagaaacgataatcatgagcgggactgcctgaatgacatccagaatcgcttgtgtattttctgattctcttccgatcccaaatacataatattcaatagagcctgctattccttgagagaaaagggcaatgaaaaaaccggctatcgcccaaaggatagaaagtccgattgagtccttctgtccgtttcgcagcgtttctttcggaacggttctcagaatcagcagaacaacaacgagacaggcgataaagctgatgacggaccataatccttgtgcatgcagcatattttcatttgtaggctgtcctccggcataaccgaatttaaataacaagggaatcgcgattaatgcggaaaactgcatgatgatatatgtcaaaataataaaccaatactgttttctcaaatggtatgtactcctttgttaagtgggtttcgttcatctacagctattgtaacataatcggtacgggggtgaaaaagctaacggaaaagggagcggaaaagaatgatgtaagcgtgaaaaattttttatcttatcacttgaaattggaagggagattctttattataagaattgtgttagcactctttagtgctgagtgctaaaattacatattcatactattgaggaggttattacattgttaaagccattaggtgatcgcgttgtcattgaactcgtagaatctgaagaaaaaactgccagcggaattgtgttgccggattctgcaaaagaaaaaccgcaagaaggcaaaatcgtggcagctggttcaggtcgcgtgttagaaagcggagagcgcgttgctttagaagtaaaagagggcgaccgcattatcttctcaaaatacgcaggtactgaagtgaaatacgaaggtactgaatacttaatcttacgtgaaagcgacattttagctgttatcggctaattcttaaataaacaatatttaaaacatttgaggaggtcttgtaaacatggcaaaagaaattaagtttagtgaagaagctcgccgcgcaatgcttcgcggtgtcgatgcacttgctgatgctgttaaagtaactttaggaccaaaaggacgcaacgtggttctagagaaaaaattcggttctccgttaatcacaaatgacggtgtaacaatcgctaaagaaatcgagcttgaagatgcgtttgaaaacatgggtgcgaagcttgttgctgaagtagccagcaaaacaaacgacgttgccggtgacggtacaacaactgcaacagttcttgcacaagcaatgatccgtgaaggccttaaaaacgtaacagcaggcgctaaccctgtaggcgtgcgtaaagggatggaacaagctgtagcggttgcgatcgaaaacttaaaagaaatttctaagccaatcgaaggcaaagagtctatcgctcaggttgctgcgatctctgctgctgatgaggaagtcggaagccttatcgctgaagcaatggagcgcgtaggaaacgacggcgttatcacaatcgaagagtctaaaggcttcacaactgagcttgaagttgttgaaggtatgcaattcgaccgcggatatgcgtctccttacatggtaactgactctgataagatggaagcggttcttgacaatccttacatcttaatcacagacaaaaaaatcacaaacattcaagaaatccttcctgtgcttgagcaggttgttcagcaaggcaaaccattgcttctgatcgctgaggatgttgaaggcgaagcacttgcaacacttgttgtgaacaaacttcgcggcacattcaatgcagtggctgttaaagctcctggcttcggtgaccgccgtaaagcaatgcttgaagacatcgctgtccttactggcggagaagtcatcacagaagatcttggccttgacctgaaatctactcaaatcgctcaattgggacgcgcttctaaagttgtcgttactaaagaaaacacaacaatcgttgaaggcgctggcgaaacagacaaaatttctgcccgcgtgactcaaatccgcgctcaagtggaagaaacaacttctgaattcgacagagaaaaattacaagagcgtcttgctaaacttgctggcggcgtagctgtcatcaaagtcggcgctgcgactgaaactgagctgaaagagcgtaaacttcgcatcgaagacgccctgaactcaactcgcgcagctgttgaagaaggcatcgtatccggtggtggtacagcgcttgtaaacgtatataacaaagtcgctgcagttgaagctgaaggcgatgctcaaacaggtatcaacatcgtgcttcgcgcgcttgaagagccaatccgtcaaatcgcacacaacgctggtcttgaaggatctgtcatcgttgagcgtctcaaaaacgaagaaatcggcgtaggcttcaacgctgcaactggcgaatgggtaaacatgatcgaaaaaggtatcgttgacccaacgaaagttacacgctcagctcttcaaaacgctgcgtctgtagctgcaatgttcttaacaactgaagccgttgtcgctgacaagccagaagaaaacgctggcggcgcaggaatgcctgacatgggcggcatgggcggtatgggcggcatgatgtaataaagggatatcaacctttatatatcacaccttaaccgtattagagggattattgttctcggctttgtcctcctttcttacaattaggcaaagcatgacaacaaaagagccaattacaagagaaggtctttcatcagttcactgaactgatgggaggccttttcttctgaattggcggtcatatgagcgtaaatattcattgcagtatttatatctgaatggcctaaccgttgctggatctctttaatgccaactcctgcttcaattaataaagaggtatgggtgtttctgaaagaatgaggagtgatattcttctcgatcccggccattttgagcaaccgtttgagcctggttcaataacttttctaaattgcggatggccatctttccgcgcaaaaaaacttgaatcctgataaaccaacctgttctcaacttagtttcattctaataaattttttactttctaagaagaccgacaaatatttcatcaattcggatggtacggacagatccttttgttttaggtgttagcagctggtatttcttaatatgaatgtttggattgtaaagggtctttgtgatacggatcgaacctagttcatcgctgaaatctgtccagtttaaagcaaggagttcaccaattcttagaccagtataagcaagtactgtgaagaccagattaccatttctaacccattagtttgtgtgagctttagaaagtgagctaagtcctctttttcaaaaaagaaaatctcctctcgtttcttttccatatcatctatactttgttgcttcctaggtaattgaaaatcttcggttggatttgttttaatcatcccttgagttttggcctttcggaaaatcatacgaccgcagacatgaatacctcctatataattgtggatatatttctcattcagctctaatacgcgctcttcatacattttctttgtaattttactaatcggatatgatccccacacaaccataaaatgcttcatctccttctcacgggcggcgcgtacgttgcttattttttactccgcttcgactatatgtcttcagccaatcttttgcaaaggtttcaaagggcatgtcagactcattaattaaagttccgttgtctttttgaagttctataaggcgagcggctactataattgcgtttttttgaatatatttttaaaatcaaaattttgtagcaataatgtctgatcgctgacgttatttgaatttgtttgttcaatttgctttagataaagcattaaaaatttcattgtattatttgtcaaaaaaatttagtaaaatatgtaagtgtgacagtattaaaatttaggaggtaagtatgtattctacaaatgaattagataagtacatgaggattattagaacttacatggatagttttgaatgttcagttgaagaggcaattgaaagcatacctgctataaactgtgatcttgccataaagattaaggaagctttcaaaaaggaacgaccaactactgcagttgatcctaatatgataatagatcctaataggaaacatgttgaatggttaccaatggtcgatagggcagaatggtattattggcctactcttagagaatatttaatagataaaaaacaatggtcactagattccgtagtgcgtcaaatagatcgatcaactgataaaattctagaacaaatggaagacccaataaattgtccttcgtttaccactaaggggctcgttgtgggatatgttcaaagtggaaaaactgctaattacactggcctaattgcaaaggcagccgatgcaggttacaagttaataattgtacttactggaatgcataactctcttcgttttcagacacaaacacgtttagataaggaattagtcggtatttcaaatgatttacaagttggtgtagggaagccaccaagagataaagagtgggttactttaaccaaggcggatttaactagaggcgattttaatcctggacatttgaatccaacaatattaaatggagataagcctattctaatagtagtgaaaaaacacggtagtatacttgaccgattgttaggctggttgagtcgcgctgacaaagaaacactaagtgaaattccctgcctaattgtagacgatgaagctgatcaagcatcggttaatactggtgggaaccggccctatgatgtagatcctaataatgaaaccgaacaagaatcacctagcgcaattaataattatattagacagatagtaagcttgtttaataaaaaagcttttatagcttatactgctaccccttttgcgaatgttttaatagatcatagagctcatgatcgcgtttcgggagaggatttatatccaagttcttttataatgtcacttccccgtcctcatggttattatggtgctaaagagatattcggcgactctaacagtctaggattagatattatttaccatgtaaataaaagtgatgtttcacaattggtgccggctaccagagcagaagtggaaactttcacccctagtataccagaaagcctggtaaatgctatttatgacttcatcctagccggagcagcgagaattagtagaggtcaaggaaatgaacctgcctcaatgttaattcacactagttaccgcacatcaattcaggaaaaattagccgctttagttgatggaatgttaacatcgattcaggaagaatggagatataacagaaaacaagggaagttaattggtttgttaaaaacaaggtgggataaggagtttcgcacgttaacaaacaaaatgaatgcccagtatgacattccttttagtaaaattataaatgatatttcagtttttcttgaaaaagtgaaaatacgtcagctgcatagtcactccactgatgtaatcaattatgaagttgaaccagatttaaaagcaatagttataggcggtaatcgtttatcacgaggtcttacactagaaggtctattgataagttactttgtccgtttaagtaacggttacgcatacgacacattgatgcaaatggggagatggtttggttacagaaacggttatgtagatctcactagaatatacactactctctctttggaaagaaaattcagagctctagtagacgttgaggaacatcttagaagggatatagctaaatatgaacgtgaaggccgtactcctcttcaactaggtgtgagaatccgccaacaccctggcatgctagtaacaagtccgcccaagatgcgagcagctcaatctgttcatgtttcttaccaagatcaggtgtcagaaacgactgtatttccgtttgatgatattgaactcttacaaaacaacttggaaagtaccaagagttttctgcgaagcttaggtaatccaggagaagacgaactaatatgggataatattgattcacaagctgttcttgattacctggaggtatataatacagatccagatgctactaccgtcagaactgatgcaatttcaaattatatcacccgcatgaatcaattggatgagccggagttaaacaactggactgtggtggtaatgggaagaaaaataaaaagtgaccaattaggaacaatagatcttggagtaccagatcagcaggtcaatttaattcagcgtacattgagaataaacagctcttctttaggaactatcatgtctgccggtgatgatgaaattagactaccaaaagaacaagttaatgaaattaaaaaacgattaaaaggtaaagaacataatgaagaagaaaaagtaacgcttggagaggaattaagaaaacttcgctcacctcaacagggagttttgttaatatatccaataagcaaatactctggccatgatcctcgaacaatagaaagtgattcccgaactgcaatttttgagaatccagaagagggtgagcacattatcggattagcttttattttccctccttccgaaagtagcgatgctcaagagtacattacaggttctgtaggggtgggaatccaataatgcaaactattgttactgaagaatcatggattgaagttgaagcttttgtccctgattatggaaaattaaatgttcaccgtattaattatggatccagtttaatactcgcatctgaccatgttggataccgacatatacttctacctttaaatgatatatcagaggcaattaaggataataaaagtagaggaattttggtgtatggtcgggatctaaaaattgatgatcaaccaattcgcgcatacttggatgtgtgttgcatccaaaaagataataataacttgttcaatgttatagcaaatgaaatttgtaacaggcttaaagaaggcgacagcccttcttcagcagttagtactacgcttaataagtggcggaaattctggctcagaggattgaaaccgattttaagtgaaaatgaaataaagggattatttggggaactatggttcttgaaaaactggttattaccaaaaggaaaagatcaaattttaacttggtttggtccaaatagaaatagatatgattttgagagtaataacttttcagttgaagtaaaaacaacctcatctatggcaggacatgttcataagataaacggcttaaatcaactggaaatacccatgagtgaaaaccttttcttttatagtttgcgaataagaagtgatatgaggtcaaaatactctcttccttttttgataagaaacattcaaaataccctttcagataatgtaaccttactactagagtttgaaaacaaaattatggaatctggttatttaccagaatatgaatcagaatatgaagatttctgctttagtattgtcgatgaacgtatgtatttagtaagtgaaggatttccaagacttactttaaatgaccttaaaaatggtgttcctcagggtgtacaaaatattcattacgatctaaatctaaataattgtacgagttattttttatgtggttcaccaaaggactggcagttggaaagtataagttattgaacatattaattagatcctcttctaaaggaagaggatctttaatgggtgcccggcatccggtgcagtctaaagggtgaaaatggattgtcagcactaaatcatacctcatctgacgaacaaactccgttttaatgattttgaacgtggcttccgccacggcattattatatggacagcctactcagagatcgtctaatgttgaaagcaactaatgtttcatcggtcagctggtttttgaactcgctacacgatctgtatgaaacagctggatgtcgcacagatcatcttgaatggacgcaaaagcccgtacgactaagttcgcgtctttatgcaaaccggtgctggacccggtgatttcgattaaaaagatcgacaaagattcatacgtaatgacatttaatttgacgttgacgtatgttaaatcgctacgatcacttttttcgcttcttcctattgaaactctcgtttcaattcatttgcctgagcagactcattgcatggtgtatttgcggtttgaactggctaccgtataatacgaaacaagtgcccgctcgttcataatgtgaccgattcgacgtctggataccataagcccgtgtttcttcagttctacctggattttgcgaatgccgtaggcgtaccggttttgtttaaaaatctcgattgattgcgctggttacatcgtcttctgattggcactcttttgttcattatagtacgtatttcgggaaatttgcaggaagtcgccattgctgttaccgagtatttgtcttggttttcttgctgacatttactttcatcccgagtccctggctatttgctttaaaatatcattctccatcagcagctaattattttcattgcgcaattttaaaagcttctgctgttcaagggaacgattgtctttttctttgaaggaaccgggcgtttcatcctgttgaatccaccggtcaagggaggaaggagtcaggtcatactcgccaggtcaagtgtacgtgaccttaatttatctgttcaaacaagtataaacgattcattttcatatggagagtgtttagaatatacaaacgaagtggaaataatctgggaaatgagtaaaatattaaggaggaggactcggccttttattgtatgatgaatggtagaggtgactaagtgatgaactctgaatttcaaatagttagatggggtataccaggttggttatttttcgttacatttttgctttttaaattaacagttactgattttaatattattaaacttatgaattcttttactaatccagctgtggtagcagggatagcggctttttttgttgccttaggtgtgcctttaggatatgtgttttatcaggtatattttgcattaaaatggcgagtaataaagaataaaactatttttgtttctgctaaaggaataccagaattggaaaatagtttaggagataaaagcaacttggaactttggaatgccattgaagcacattttgatcatcttatgacagtagtctctaacaaaaaggacttatcatacaaagatctggtaagaaggagtgagtattttaataatagaacatcaagaattcatgggttgggcgcttctgcattatcaatgtctatggggtttgtattctttttttgtactacccaagtcgtgctgctcttttggataacaattactttattgtcactcttgtcttttttctattggcttttggtctgttgcgtataattattacattcagaataaaaatagttttctgcaatttaattatttaatgcgagacataatagaggctgatgagagaaaggatgataagaaggaagattcagatgaagaatagtcgctcatcgataataatttttaatcttatacttttagcagggctttggtggttcggatatataacacatgacccagatattgaagatccttatgaattaacgaagatcatgcttcagaacaggatcaagatgtatctagaatgattgcagagtcgccgaacattttaagaaataaaaatgctgttagaatcgttttacgaacgcttcagaggatgcaggagggttcagaaaagaagttttcaaggcgaacttttatacgctatgcggcaatctatcttaattttcggggaggtgttacggttttaacagcattaaatgatgaagaaatgaagttagttgtagaggaacttattaaaaattggccgtcttatttagaaaaggaacaaagagcaaagaaaagactggtcaaaaaagaagcttataaactcctaaactatagactaggagtttataagttattattaaatagtttttttatctgtggtaattactcaatatatcccaagaagcatataaaaatagcacttttcttgcagaatgtaagtataaccaaatccgaagagcaaggtgcctatgaaacggaatagctactcttgtcattgactgaatagctaattttttacgaaattattccggggttttatagaatatgtgtattgcatgggtacactgtaacccagtcggtgaaaggtattgttcttcattttaaccagcttgatgaccatttgaactgaaaaggcggtagaaacgtatagcaagctgagcgatttcggtagatcaaacagaacttgaacatgtcggtactgtcctatatgcatcaaatatagtttttaaccagctgtttgtatatttattgtttatctgctaccaaataactgttttcaaataaataggtcacttgttccctggtaagtgccctcctgtattccttattgattcttaaaggcaacatcagtcgaccggcagttgaattaaccacgttatattaaattaactctatctcaatttcggtttgactaatccacgtaattttaacttggtcgcctacttgcgcatttacatggcggaaccattgtccaattagctgaagatttccgtttccttgaaattgtttagcataaatatcgcctgctgtgctgcatccagaggctttgagagatgcattctgcagaaacccatccgccgaattgcatgtgtaaataatattggcacctgaacaattgctgttatagatgcctaatgacattgcttcctgtcttggaatatgtaaatagccttctccatatacagtccctcttgtatttgtatgcctgtgagagccccattctaaatgagctcgctttaatgttgtagtgaaagtatctccaggttttggcacgaaaaaacctccctttttcatcataaattaagtctaatttttgtttgttaaaaatacttgaaggtcgctgaatcccttatttttaattcttgccaaaaacagctctactcgctctttttttgatagttcattctcaatacagtaatccagaaagccgattaagacttctcgtgtcatcataaagccctcgatttctctttcaaccagctggctgcttaaagtggtgatcgatttgagtttcttttgtccagaaaacttgcttgatgtaacgtatccgtaaaaaaacagttgtctattttcgaattgaaggtaatttggaatatactctgatgccatatagttggctaggttttgcgttagcacaaagctgcttggataatgctttgtgtcaataatgccgcatttgtcttcgtgtataagtagaatttcaatctccgttttctttccgtcaacttttggctggtatactgcttcaaagccaattgcctcaaaaattttcagcgtttccttttcaaactctgctggcgtcagctcacccaagtatttttctacaaacgcttctggtacgctacccatttcgcgtacttgaaaacgaagtacatctacaactttctgggcatcacgcggcccaaatgatggcagaaaatagggaaggagctcttctctagtcaactccgttgagttgggaatatcgtttaaaatggcctcgattttcccctgaatctttccatgattgctagcaggctttactacgccaaaattacttgctttgtagctgtctacatcaagaccgctgttctgagccatacgttctactgaaattagatatcgtgcattaaaagggtaacggctgtcgtaatagctaagcacgttctgtgcttccccactaaagtgggatcggtctttaatactgcctcgccgcgttgataatcaacaagcgctgtatattcgcacagaagcataaatgtatgcgccacatctgaatgagcttgataataatcccttgctgcgttgtcatttcgggcacggtggtcatattctactgcaacctcctgtttcatcaaacgctgctcatcctggccggcattgcggtacgcaataatccgtgcagccacctcatccaactgtttgtcatgctgtgcagtcaaaacaaagtaggtgatttcctcctttgtaagatgatattgtaaatctggacgttgtaccagtttaattaaaaatctggcaggacggatacggaatcctgcttcaaatttgggacggaatcctgcttccatgaaataggcattggggatctggagtgtcaaaatttgtttttttacattttcgtactctttagtgccattgataagtgcttttcccgattttgttggtttaactagaccttcgccgtctatgtagcagtaggcaaatgtttttaacatggcgcaccaggtacgacctcccgagccatcattgcttatattatttcgctttaaccctcttgaggctagcactttttcataatgtttatgtgcttccctgtttcccagccattttatagtaaaattttctgtagcttctgccagcgcttttactgcatctgcatggaaatgtggatcccgttccggccttgtaataaaccatacttttcgttcagtcaaccttcgtcatcctccttgctctttctgttctcagtgcatcctgaatatcttttctctctttcaatgtttcaagaacctctcgcttagataacttctcagaggaaagcggatgtttttcataaaagagaacgatctccacaataagagggaaataggtatgaatcgcgctttccaaattttctgcatcttcaacgaatgatattgcatcaatgctttgtttatattttgcagttagatcttctagattgggcagggtgttcttatccaaccccctttcttgatggatttctagaaacgccttccaatagcggagaaacattactgcgctaaagacaacacccgtattcttatcacgatatatagaattcagtccttttccggatttttccgagaggaggctgtttatttcactatctttcatagtcttctttaatggagtgaatatctcttgaaaaaggagttgtgaacttaaatacatttcaattagaccttttaaactgcttagagaagtatcttttgattccttagacactagttatcacctgcttattacttaacttatttactactttacagaacaatccaacggcaaaataattcgtaaccgaattattttgccgttggataaatttattgaataatccgtcactttttgccatctgcctggagggatgttgaatattataacaaataaatcaatcgattccggcagtaatttttgtacagaacatcaaaaacaaggacaatgtacacattggaaacattatcaataaagatatatttaaatttcagacagcctgaaattaactacttcatattacaaataaggaataaccacttgtatcaaaaagacattatttaaaaatcagccatggggcttcttttttttgaggaaaacgtgtaaactaattagcgtacaagtatgcaagaacatattttcgtataaacgttgaatataggtgaaatgaagaggggttttaatatgatttttaaaaaaggagaactgttcaatggtcccggtggacttagtcttggtgctaaattggcaggttttgtgcatcctgacacgggtaaagaatggcggatagagcatgtgtgggcaaatgactatgatcctaatgcgtgtagcacgttccgctacaacatttgtgggaatatagaagatcagtctgttcactgttgtccggttgaacagcttccgatcggtgataaaacagtgcttgaagaaatcgactgctttgcgttcggattcccgtgtaatgattacagcaatgtcggtgaaaagcagggattgaacggtacatacggtcctctttattcgtatggggtcaaagtgctggaaaagtatcagccgaaattttttgtggcagagaatgtgggggggcttcaaagcgccaatgaaggaaaagcctttattaagatactaacagagcttgaagaatgtggatacaagttgacgcctcatctatataaatttgaagagtatggtgtcccacaggcaagacatcgcattattattgttggcatcagaaatgactggacagcaaaaggtgttaaatttagagtgccggcaccgactacactggcatcaacagactatgtgacgtctaaacaggcaattacagagcctccgatccctaaagatgcaccgaaccatgaaatgccgaagcatacaaaaaaagtgcaggaaatgctgagttacattccgcccggtgaaaatgcgtggtatgcaggaattcccgaggagcttcagctgaatgtaaaaggagcgcgtttaagctcaatttacaaacggcttgatcctgaacgcccagcttacactgtaactggcagtggtggtggagggactcatatgtatcactgggaggaactccgcgctctgacaaatcgagaacgcgctcgtctgcagacatttccggacgactttgtattccaaggaagcaaagaagctgttagaaagcagattggcatggctgttcccgttaaaggtgcgcaggtcgtatttgaagctatcttaaagtcgttcgcagggattgaatatgaatgggtagagccggcaagaaagcttcagcttgaaaatctccgtggccagagaaaagtaacaatcgatgaaatcgaaaatgtgaaagaacagcaacaaaaagaaacagaaacccaaatagtactgaagatataagtatataaggcggcgcctttactaaggtgccgtctttttcgcttgtttgataaacctttcaatctcatcaaccacttttttgaaatccgccttaaattcgtgttcccagatccgcttaaaattccagccatgctcttcgtaataactccttacttcttcatcgcggttcctgttcctctcaagctttttatcccaatattcctggttacttttcggccgattgccgtgcacttcgcatccgtgccagaaacacgaatcaataaagataactattttatacctttttatagaaatgtcaggttttccgaacagggaattatcatttttgcggaagcgaaggcctctatgccatagttctttagaaactctgttttctagttttgactgtgaccgtatagactgcatatttttccgacgttgctccggagtcatattgtcagccatagtacacacctccctatatgaatatttccttaaaattcaaggagtgtagaggtctaaaaattttgccttacaagactatatgtaaagcaggacttatgataattactttttaaagtgaaaatcgcaaaaaaatcgatttagattggttttttgtttaaaaagaaattagcgagatcgttcgttgcaagatagaccttacaccatgataattaaaatgtgttttcgttatacccttcaatcaccatatccaatcgttccacctctccccgaatcccaatcgcaggctcccacgaatcaatcaaacgaatggccttctgattagattccatcgctttcgttttctttcctttacggtacaacagctgcgccattccgtaaaaataatagatcaactcaacctgattcgcgttttgtttgtcatagagcatttgctcaaaggcttcttctgctttctcaaactggtcagacttcacgtaagcgacacccagattaaaataggcttctatcgttttttcgccgccgtacgtggagctaatttcatttgctgcttcgtataattgaatggcttctttatgatgacctctcgcaaagcttaagtcaccgcgaaccaatagaactctgtgttgaatggtaggggaaatcggttgattttcgatttcgtttaaaatggtctctgctttttcctgttgcccgtcttttaaaaaaagccttgctttgagtgcgtgtccccaaacctttagatcataggcatcgtgagcgtctgattgttccagaatcctcagcccggcttcaatttgctgtaaggccctgtctaaatcattgacttccatcagagcccagcctgctgtgtcgattcggaagtacgcttctcgtgtgtgttggcctaagtgatgggcggcgtcggccgctttgcgtccgtattcgattcgcaggggcaggttgattctgcttagaaaatggctaatgcgggtgatgagttcgattaggatttctttttgttcagtttcacttgcccattggatgacctttaagatgtttggccattcttttttcatttgatctaagttccgtcccagcaggtagctccaatagatagagttgggctgttcccgctttaaatgggtttcggcataatcaacataatagtgcgcccagcgattgcgggcttctttttcatattcgtgctgttcggacaagtgctgttctccgtaggcgacaacggtttggtgcgctaagtatagcgtcctgccttggcttcgttccggctgaatcagcgcatatgaccgcatttgttccatagcgtaatgaaaacggcgggcgtctaatccggctgctgccgccaggcttttttcatctggcggcttgctgaaaaagcaaagcgtctgccatagctttcgcgtatcttcattgcatctatcccaggtgcggccaaagaggaattcaaacaattccagcagtgagtagcctgcttttccaagctcatgaatcagctgctgagcggggatgtcatcgtctgacatataggcaatgctgagtgccatggctttcgggtttccggcagtcgctgaaatgaattcgtttttcaggtcagatgatagatgtaacagctgctccagcttttcccgtttattttgaatgttgcatgtttgtaagcatcggtgcacttcttgctgaaaaaaatccagggcatctgtttggtcaaggccgctcagctgaatagctgtcatttctccgaagctttcccgataggtttgctttacgttttcccgcgctgtgaggagaactttcacaccttgcggaaggctggtgataaattcatgaatgtcacgttctgcagtatcaatgctgtcaacgatcagcaggatcggtttttctctagtgtaattagctaacgcattgcggacgacgaaccgtttttcattgattgatttatcgatttgttctgtgcgcccgagctgataggcgatcgtatttaaaaaatcgctaaagctcaatcctttccaatcagcgctgacccaaatgatactgttgaacgccggccaatctgaagtatcgtcgacacaggaataggcggcttcaagagcgattgtggttttacccataccagcccagccggtgataaaacagactggtgacggagaaagcatccattgccgtatcgcttccatatcaaagctgcgtccgataaagcgtccggaccagcgtgagggtaaattatgagtgataggctgttctgtaagcgcattcgtttcttggccgggtctgtcatgaaacagccgttttactacattttcaatttcgtcttcactcggagccccgaataatccgtcttttcgcagtattttcgcttttttcaaacaggatgctgcccatacaggcaatgcgggtttgatgactgggatagtggtggcttccagcaagtcggtcaaccactcgatatccaagtcggtcttttcgagaatgatccagatcattccgaacagttttccgtcgtcgattcttccgggaatgtagtttgcccccatctgtccgatccagcttttgatcgtgtttggggagactcccagctggagtgcgattttatctatgtaagactgtcctgttttttcattctttttccttctgactttataatcaggatgaagttttagcgttttgacgccaggtgccagcagttgtgcaaattgttttcggttttcaagttcagccataagcctgcacctcctattagtactattttatcaatccagcgttttttgtatatgaaaaaataaaagtacagtgccgctgtccttttatacagcaggaaaggctgttgaacgtgttgaaaagcagataaaatgggggcagtaacagagaaaacaaaaatgtatgcacttacattttatttcctaaagaaaggaatttgccaaatgactcacacagtacctcaaaacatgaaagcggctgttatgcacaacacaagagagatcaaaattgaaacattgcctgtgcctgatatcaatcatgatgaagtgttgattaaggtgatggctgtcggaatttgcggatctgatctgcattactatacgaatggccgaatcggcaactacgttgtggaaaaaccatttattcttggccatgaatgcgcgggtgaaattgccgctgtcggatcagctgtcgatcaattcaaagtcggtgaccgcgtcgctgttgaacctggtgttacgtgcggacgctgtgaagcgtgcaaagaagggcgctataatctttgcccggatgtacagtttttggctacaccgccggtagacggcgcgtttgtccaatatattaaaatgcgtcaggactttgtttttttaatcccagactcactttcttatgaagatgctgctttgatcgagccgttttctgtcggcatccatgcggcggccagaacgaagctacagcccggatcaacgattgcgattatggggatgggccctgttgggttaatggctgttgccgcagctaaagcatttggggcaggcacaatcattgtcaccgacttagagccgctgcggttagaagctgcgaaaaaaatgggagcgactcacattattaatatacgtgaacaggatgcacttgaagagattaaaacgatcacgaatgatagaggcgttgatgttgcttgggaaacagcagggaatccagcggcattgcaatccgcactggcttctgtgcgccggggcggaaaattggcgattgtcggtttgccttcacagaacgagattccgctcaacgtaccgtttattgcggataatgagattgatatttacgggatcttccgttatgccaatacgtatccaaagggaatcgaatttcttgcttcaggcattgtggacacgaagcatctagtaacggaccaatattcgctggagcagacgcaagatgcgatggagcgggcgcttcaatttaagaatgaatgtttaaaagtgatggtgtatccaaatcgctgagtgaacagggaggatcttcgtattctccctcttgtttactggaaatgaaaacggattcttggggtgggaaatgatgattgaaacagaaaaagtaacggcaatgaaagtgaagcatcagtcaaaatccagtaccggactgtcctggtttgaacgaatcggctatggattcggcgatatgtcgtataatattatctttcagtttgtaaacgcatacttattattttattatacagacgtcggcggcattcagcctgcggtgatcgcaactttgtttcttgttgtgcgtgtgctggatgctatttttgacccgatcatgggattgattttagataaaacaaatacaaggtggggaaaagcaaggccctatttgctgtgggtggcatttccttttgcgctattcacattcttatgtttcacgacgcctcatttcggtgagaccggaaatatggtatatgcgtatgtcacttatattctgcttgggatgtcctttagtatgcaaacgatcccggtgaacagcttaacggggcggatgacgaattcggtggaggaacgaacggttctgaccacaacccggatgattttggtgtatatcggcattcttttatccatttcctgtgcgacaccgcttgcaactgctatcggaggagaggatcaggcgtttggatttcagatgacggcgctcatctatgcggctgtcagcatcgttttgaatctatttagtttctttactgtacgggagcgaattcagcctaaaaagagaaaaaaacaagggatcaaaaagacgttatccgttttattccgaaataaacccttgcttatgttaatttcatcatttttggcttttgcgatcgggtttaatattaagctcagcacgatggtgtattattttacgtataacgtcaaccataaagagttcgtgtttatgggcaccgttttatttttcggggcagcgctgatcagtaatttgtttattcctttcttttctgagaagtggggcagaaaacaagtcatgatcatcacggcagctctatcgcttatttcttatgccggcctgcattttacgccgtattcttcaattccactcattttcatttggcttttcgcttcgggatttttcacaacgcctttaaatacgcttgcttggggaatggttgcggattgtgtcgattatgcggaatggaaaaccggaattcgcgcggatggtgtggtgatttcgagcatgagctttatcaataagctgggtgtggcgttggccgggtcattttcggccatctatttaggaatcgccgggtatgtggcgaatacagaccagacagttgcgtcattgaatgcgattaaaaatatgaatgctttgattccgggatttttcattttgctttctattattcttatcgccttctatcctttaacggaaaaaagatataaacacatcatctctgagctggagcaaaggtctgcgagataaatatatgtaaaatttttaatattcaatgttgtatttatggcagaaagtaatatactgagactgtaatctagactttataaatgagtgtgataatatgcgtagtcattctgtagtttgtattggggaattgttgattgatttcttttgtaccgatgttgacgttgatttaatggaagggcgccaattcctgaaaagtgccgggggtgcaccggcgaatgtgtcagcagcgattgccaagctgggcggagacgccgctttcagcggaaaagtaggaaaggatccgtttgggtattttctgaagcaaacattggacgctgtacatgtcgatacctctatgctggtgatggatgagaaagcgcctacaacgcttgcttttgtttcattaaaacaaaatggagagcgtgactttgtttttaatagaggcgcggacgctttgtttacgctggaggatattgaccaggaaaaactaaacgaagcgaaaattcttcatttcggctctgcgacggcactgttatcggatccgttttgctcagcctatttacggctgatgtcgattgcgaaagacaatggacagtttatttcgtttgaccctaactaccgtgaagatttatggaggggaagagtctcagagtttgtaagtgttgcgaaaaaagcgatcgctgtaagtgattttgtgaaagtcagtgacgaggagcttgagattataagcggtgtgaaggatcatgaaaagggagttgcgatccttcatgagatcggagccaacattgtcgctgtgacacttgggaaaagcggaacgcttctttccaatggaaaagaccgtgaaatcattccaagcattcctgtgacatcaattgactcaacaggggcgggagatgcttttgtcggtgcggctttatatcaattggcaaacacggatcagattcaatctgtagaaacagattttgtgaaactgcgtgagattgtggcgtttgccaataaggtcggagctcttgtgtgcactaaaattggagcgattgatgcactgccgagcttggatgagatcgaagtttctttgtaaatcattgaagatgtttcttgaaagtctttggacttttgggggcatctttttttattgcttacatttttgttcaggtaaaaagttgtgtattttttgtttggaatgtcattttttattaaaaaagtgaaacttttaacgataataaatagtatatgtaacaagggttaccgaattagctttaggaggaacgatataatgagtataattggaagatttaaagatattatgtctgcgaatatcaatgctttattggacaaggctgaaaatccggagaaaatggtagatcaatatttaagaaatatgaatagcgatttggctaaggttaaggcagaaacagcagctgttatggccgaggagcagagagcaaaaagagaatatcacgaatgccaggcggatatggaaaagatggaaagctatgcaatgaaggcgctgcaagccgggaatgagagcgatgcgagaaaatttcttgaaagaaaaacatctttggagtcaaagctttctgagctgcaggcggcgaatcaaattgctgcaaccaatgccgcacagatgagaaagatgcatgacaaattggtatctgacattggagagctggaagcacgtaaaaatatgatcaaggcgaagtgggcagtagcgaaaacgcaagaaagaatgaacaaactgggcgcttctgtttcaagtacaagccaatcaatgtctgcattcggccgaatggaggacaaagtaaataaggcacttgatcaggccaatgcaatggctgaactgaacagcgctccgcaggatgatatggctgatctgactgcaaagtatgacactggcggttcaagccagattgatgatgaacttgcggcgttaaaagcgaaaatgatgctcgataagtaatacataggaggccgcagctctcggctgcggcgtcattttatcataagatgtgagagggaacggtaatgataatatcttataagtgtccgaactgcggcagtgatatggcatttgacagtgaaaccggctcgttatcctgcagcagctgcggaagacaggacaatattgaaagccttccgaaagaaaacattgcggcacggttttctgatgatgaagcaaaagaatatcaatgtgaaaactgcggtgccgttttgatcacggaagctgaaacgacagcaacgacgtgcagcttctgcggaggtgctgcaatacttgccgatcgtttatcaggacatttggcgccggcgaaggtcattccatttacaatcagcaagcaagaagcggagcaggcatttcgaaagtggtgcaaaaaaggccttctgacaccaagaggtttcatgtctgccgatcgcattaaaagcatcaccggcatgtatattccgttttggatgtttgatttaaatagtgaagtacaggtgagagcaaactgtaccagggtccaccggtatgaagaaggggattatatttgcacggaaacagagcactttgaagcgtttcgtgatatcaatctcgattatttgaaaatccctgtcgatgcctctgaaaaaatgaaagacgaattaatggacaaattggagccttattcatacgaagagctgaaggactttcaaacggcatatttggccggttatattgcggaaaagtacaattataccgatgaggagctttttccgagggcaaaagagaaaatcagcagttatatagattcatacatccattctactttttccggatatacgtcagtcaatgtgagggacaaacatattcacacgaaaaacgtgaacagcttttacgttctgcttcctgtttggatggtcagttacgattatgaaagagcggagcatatctttgcgatgaacgggcaaacaggaaaggttgttggaaagccgccgatcagtcgaggaaaagtggcggcatggtttagcggaatagcaggcgggacatttcttgcgttgaagctcgtctcattgatgatgggaggcggattttgatgcgtggattttttgggaaagcgatctttgttgtgctggctgttttcatcatgatgcctttactgggtatcgaagcggcaagagcctctgaatcgcagcagcatgtgtacgatcgcgctcatctattgtcaaaagcggagatcggaaaacttgaatctctctcggcagagctgggtgcaaagagagacactgatttcatcattattacgatcaaaagcacaaacggtgaagatattgcagactataccggcgatttttatgatcgttacggaaaaggcagtacagccattctgaccattgatatgacaaacagagaagtgtttatcgcaggcttcaaaaaagccgaacagtatttggacaacagcaggctcaatagcatcagaaatacgatttcatctgatttatccaatgaaaattattttgaagcttttgagacatatattcagctttcctataaagatatgggcataaaaccgggagtaaaccccgacaacatattctttacatggtggtttcagctgattgctgccatcgcagtcgggggaattgcggtttcaatcatgctttatcatgcaggcggcaaagtaacggttaatggaaatacatatatggatcagcgtacgtctgatgtgattgatcaatacgacacttatattagaacgactgtaacaagagaaagaaaaccatcagataaagacagcggcagcgatggcggtgttacgaaaggcggcacgtcatacagtgggagccggggcagtttttaaatgtaagaaatagagaaagggagaggcgtaatgtcgtttttcagaaatcaattagcgaatgtagtagagtgggaagaatttagagatgatatgattttttataaatggaacaatcgtgaaatcaaaaaagggagccgtttaatcattcgtcccggacaggatgctgtctttttgaacaatgggcgggttgaaggagtctttcaagatgatggcgattatgatattgaatcagaaattattccattcctttcaacgttaaagggctttaagtttggctttaacagcggcatgcgagctgaggtgctgtttgtcaatacgaaggaatttaccgtaagatggggaacaaaacaggcgataaatattccggcagcgggaatgccaggcgggatgcccattcgcgcaaacggcacatttaatttcaaggtgcaggactatatcaacctgattgataaaatcgctggcgtgaaagatcaatattttgtagaggatattaaaacccgtatcatttctattctggatcagcttctcatgaagtggatcacaagagaagggaaagatatgtttaatcttcaagcaaacgcttttgatattgccaagggaattcaagaggacttagatatgcaattaataagcgacgggatgacggtcactggttttcaaatcatgagctttaattatcctcaagaggttcaagatatgattacaaagaacgcttcctacggtatggttggggatgtgaacagataccagcaaatatcaatgacggatggaatggcatccggaaagatgagcggaggcggagcggcttcggatatggctggaatgatgatgggaatgaatatggccaatcagatgatgaaccaaatgaatcaaaatcagcaggcacagtcatcaggcccacagtcaactggcagcggaagcaaaccgaatttctgtccaaactgcggaacaaaaacgggcgaagccaatttttgtccgaattgcggccagaagcttgtgtaagactcatacagtgaaaagtccggagtgatcagcgctcgggacttttttatttagaagaataagcgttacctattgcttgctcctgaacaggccattttcgagcacccgcttggataattcccagcagcaattgacgacgttcctttattgaattgacggcaatttgaaatgtttgctttgataaagccggtatgcctgattgttgaagctttgagatgtctggttccggcggcgcttgttctgcaggatggatataggcagtatgaacggtatccagatagtttttgatacttgagcgcgcttctttgatatgaagctgattcggctgatattgttcaggaattccgtatttgaaaatggttagagcttcatccaatacagcaacagctataatggatgattcctgatgctgcgtgctgtggtaaaaatgaaggatggggaaggcgttatgctgagcggtcagctttcccagttctgatgaggcagcgacaagaagaaaatcaatgtcgtgaaaatctttgccattccatgcattatggacgatttctgttccgtcatgccctagacttaatacactttgggcaaaggagcgtttttgattaaccgcactcaagacggaaatcaaatacgtgacagaaaacgtgatggtaagcagtccttgagctgtttcaataatcgtgacaagcttccataggcctccgttcggagcgaggtcgccatttcctaatgtaaacatgacatagccggaaaaataaattcggtctgaccaggaagccggttcttttgattgagtttccataagtgagtgagggtcactcgagtaaatcaacacccatccgccccaaaatagactgatccatatcactaacgtcaggcataacagcagaggaccagccatacttagaacctttgcgtggtcaccgctgattttgcggcagcccttccacagccaggcagaaaggcatcttgtgatcgggcctgcaccgctctctaaccataacgtggtccataaaaaatcaatcatccccgctgtcaataataaaaggcctgcaatgatataaccctcattcattttggttgcctcccttaagtcagccttcttttattttcttctctatttccttttatcctgagtctgaaacaattgaacgaatgtttgattttacagagaaaaataggagaagttaaccaacacttactcatttatcgatatgaacaaaaaatcacaggatttttgacttgattcacacattttcatgaagaaaaacgttcattttccccttgaattggtgattttccttttatagagtaaaaaattttcagaaatttatattgactgaaagcgtttttataattatgataatatcagatgtaacaaaaatataactatcatatcactacaattgaactatcaagtgactattaaatgccaaatttacaaggttatgcacaaagaaatgaccattgctcttttagtgagaaatgaaatcgcttccattgggactgacatgctaagaagaagggaaggttatgaggttattggataaaaacatgaacaactattttctgaagcctgcttacgaaatgtgaggaaggcagcagccctggaatgagtttttgacatacgcattttgaaaaagactgggggaaacagtatgaataaacaaggcaatcaaatgtcatttttacgtacaattattttagtctccacttttggcgggcttctttttggctatgataccggtgtgctcaatggagctttgccgtatatgggagagccggatcagcttaatctcaatgccttcacagagggccttgtcaccagttcacttctttttggagcggccctgggtgctgtgtttggcggcaggatgtctgattttaacggccgccgcaaaaatattttgttcctcgctgttatattttttatttcaacgatcgggtgtacgtttgcaccaaatgttacggtcatgattatttcccgttttgtgctcggtattgcggttgggggtgcatccgtaacggtgcctgcctatttagcagagatgtctcctgtggaaagcaggggacggatggtgacgcagaacgaattgatgattgtatcaggacagcttttggcctttgtttttaatgcgatccttggaacaacaatgggagacaactcccatgtgtggaggtttatgctggtcattgcgtcacttccagccttgttcctgtttttcggcatgatcagaatgcccgagagtccccgctggcttgtttctaaaggaagaaaagaagatgctttacgtgtattgaaaaaaatcagggatgaaaaacgggcagcagctgagctgcaagaaattgaattcgctttcaaaaaagaagatcagcttgaaaaagcgacgtttaaagatctttcagtcccatgggtgcgccgtattgtgtttattggattagggattgcgattgtacagcaaattacaggtgtgaattcgattatgtattatgggactgaaattctaagaaattccggtttccaaacggaagccgctttaatcggaaatattgcgaatggtgtgatttcggtattggcaacattcgtcggaatctggctgctgggaagagtggggcgccggccgatgctgatgacaggcttgatcggtacgacaacagcgttattgctgatcgggatattctcacttgtacttgaaggatcaccggcacttccgtatgtagtcctgtcattaacggtcacatttcttgcttttcagcagggcgccatttcaccagtgacttggctgatgctatctgaaattttcccgcttcgccttcgcggactgggaatgggtgttacggtattctgtctgtggatggtgaattttgcagtcagtttcacgtttccaatattgctggcagccatcgggctgtccacaacgttctttatcttcgttggattaggaatttgctctgtcttgtttgtaaagaggtttttgccggaaacgaaagggctttcgcttgagcagctggaggaaaacttccgcgcttatgatcacggcggggcaaagaaggattctggggctgaagtgattggataatttaaaaaagaatccgcacccgagtgcggattctttttggtttcaaattagttaggtctgacaaggattttgacttggcttttctctttaataagagccccgaagccttcctcgatcaaatcatctagtacgatttttttcgttacgagtttgtcggctgagaaatagccttctttcattaatgacaatacagccgggaagatgtcgcggtatccgataattccttttactgtacgttctttgattacgatatcgttcggatggatttcagcacctttttcccaaatgctgacgatgacggtttcaccggcaattgtagtggactggatggcttgtcgtaacaccactgggacaccagtgacttcgaatgctacgtcaacaccgcctcctgtacgttctgcaatctcagcgactacatcgtctgttttagacggatcaacgatgatcgcgccaagctcctcagctttttgctggcgttcaggagaaagctcaacagcgtaaatatcagttgcaccggcagccttcagcgcttcaatgacaagaagtccgatcgggccgcagccgaatacagccgctttgtcgcctgctttgagtttgcttgagcggacagcgtatagagcaactgcagaaggttcaacgagcgcgccttgttcatatgataattcatcaggaagtttgaacaaaagctcttcatctacagagacgtattcagagaaaccaccacctccgccggctaagccgaggaatcccatttgttcatcaaggttgtaggcgccttggtggccgtgtgtagcaaaaatcggctcgactacgacgcggtctccaactttataattttcaacgccttctccgacttcgacaacttcaccggagaattcatgccccattgtgacaggtgccgtttcatttgttaatggatgcggtttgtcaaccggaataaagatcgggccgcccagatattcgtgtaaatcacttccgcagatgccgcaccatttgactttgatctttacttttcccggctccgtttttggctcttcgatatgttcaatacggatatccttttggttatgccatcttgctgccttcatggattaccactcctatagcttttgatgtgagtaattccgcaccggtcaatatgaactgttcacaaaatcgccatttttaaaaccaaaaaagaaatgaaatttttatataatataatctacgtttttttgaaaaaagaaactttgaagaaaaaagggtctcgcacactcttttttctttatatgagagtatcaatcgtttacatatctatgaatttggtttgaacaatacggtaatggttcgttcatattgaatgcgacaactactctatcaataattataacgctaatactgctattataataggataatcttccatggtttaatttaacagaggtaacttttttgactttgtaacattactgtaaggatattgaaataaaaaatagctggttgatcgtgtataatcttcctagatgttaacaaacagggggacgaaatgttgaagaaagtcattttagccgcttttatcttagtaggaagtactttgggagcttttagtttttcatcagatgccagtgcgaaacatgtgaacggaaatattacttggtataatggagtcgggaaaaaaggctcttcaggtaagaaacttggacattgggattgtgcgaccaaaatcggatttgatgttcctagaaacgggacaaaaatcagagcttatgcaaaagcgaagcctaaaaaagtgattacggtttataaaaatgatgttggcagaatgcctaatgcagtgctggatgttagccctaaagcgtttaaagcgcttggatatccattaagcaaaggtaaagtagcggggcattacagctattaatgtacatatataatctggaaagcaagaagtcacattcttgctttttctattggtggagataaaagatgaaaaaaagaatcatattattgttagcagtgataatagcggcagctgccgcgggagttgcgttttatgttacaaaggataaaggccatgagaaggctgctgatgtttcagtcaataccgaaagcggtgatgagctgctggtttcaattacagatacggatctgctgacaagatattatgaaaatgacaaggtgatccatgaggagaagctgaccagctatccggcatttgccttggatcaaaaacagcaggtgctctattatacgggcaataatgaacagaatgaaatgaggctttttaaactggatctaaagtctaataaaaagacggtgctttataaaggcgcggagagtgcggacagtttgtttttatcaaaggaccgttcaaccatctatttccgcttaggaaaagcggacgaaagcaattttcggatcgccgcttttgatctgaaaacgaaaaagtacaaaaatctttatcctgccgctaatgatcaggataacaccgttagcagcttcttttataaccaaaaaaacgattcatttgcattgcttcattattctgtagaagaagactacaagaaaacagatgaagcaaacgaaaagggcatcgaccctgaaccgacaacgattcattttgcggaaggccgtcaacataaatttaatgagctgaaaagcctgaaccaatttatcagcgatattgctgtttctgatgatgataaacgtattttattcacatcatatacgcaaaaaggaacggagcaaaccgcttctattcaaatgctcaatgcggatacgaaaaaatatgaaagcatcatctcaaatcagaaatcatttaagctgttaattgacgcacagcctcagttttctaaggatgggaagaacatttattttcttgccgaagccaagggggctaaaaagctgaaggacgaaacagggcgtgaagctaaggtgcggacgatttattcctatagccttgaaaataagaccttcaaaaaagtatgggaaaatccgaacggcatcatcaacagcttttctgtgattaactaataaagaccactcggcatgagctgagtggcttttttaatggatgaggtgcagggctaatgatccgagccatttaaagatatgaatcagagggaccgacaaaaacagaagttcaacatagaagttcattgcaacattcagctttttgaacgcagctctttttttcaagtctttttgctgctggtttgagatcacgttatccctcctcttatatccatattataccattaaaacagacaaaaaagccctaaacgtttacagttttgggcttctttcttcgtatttggcctcttgcaataagaggcttttattctgaaatatagaattttgtctccgttcggggtttgtttgcttgcaggagactgcatttgttatagggaagaactagcttgttttcgtttggctgttgttttggagattcactaatgaacggatgccgtcgaccattttacttccgcacaaagggcacaatggcgtatcactgctggcgaagttttttcgggtccagccattacagtcttcttttgtgcattcccaagtactcacatcttcttttggcagcggttcttgatttcgtttgttatagtaagacataaagtcacttcttccctcatgtattttactgcacatttcctattgtctcatacttttccctaatctcctaattcctttttctttatgactttccaataaccccatctaaaaaggagaggagtgtgctgttaaaagcatctggctcttctaaaaacgggcaatggctgcttttagaaaaggtaacgagtgtcgcgtttggaatattgctgcgcaagtgttctccagctgctgtagagaaaaatttcttgtcttccccgaagcacagcaatgtcggcacattgatgttttggagggtgccccggtaatcagcggccgtttggttaaataaaatcgtgctagaaatggcagccggctgtttgaggatttctgccagcatccattctgtttcggtctcggcaggcggttctgcgaacatattctggatgaagctttcgtagaaaggcagcgggtcagtttgaatggcgtgcatcgctgtttttaagccgtcaaaatcaaatggaccgtgttcccagccctcccattgatagtcggaagcggattgatcgatgatcacagcggcttgaatgttatcattcccaaattgattgagataatcccatacgacaaaagcgcccattgaccagccggcaagaatgacatggtcaagctccattgcatttagaaattcccttatgtcacgggcatattgggaaatggtgtggccgtgaagcactttgtcagattcgccgtgtcctctaagatcaagacgaatacattgataattggcagaaagcgccgaaaattgtttgtggaaaaattgtccgctcatcagcaccccatgtataaacaggatcggcgtcccgctcccgtgtgtttcatagtaaaggcgtgtctgatcttctaatgtgatgtatggcatgtttctcctcctttagtttccatcatgaatatggctggctgctgttgagctgatgatggcagctgtcacggctgcctgctgcgcttgaatggctgtttcaatagcggtgtatagtcctgattccatcagcagatttttctccatatgctcactgagatagaggctgacagcaattttaaaattcatttccttttgccatttaaaagctttttcctggtttaattcgtcagtgatgcacaaaacggttttgatatctggctcttccagaaatgtgaggagagcaaggtctggataatgataatcctttggttttttgacagattcagtgatcgattgatatatctgtttgcaggcggaaacaagcatttcgggctctttttcactttgcaaggccagaatatggctgacctgatgtaagtactgtccttttttaaagccgttggctgccagcagctgatagcatgtttccgccttctgtagagcctgcaaaccttctccgttttctccaagcagtacggcaagcggaacattctgagttgaagtgaggaaataatgatttttcttcatctgctgataaactgctagccccatgttcatctgttctttttggtttgtcgtttcagatttgccggtgagcaagattagagcggaaaggtatgtgaacatatcccgcttatatcctagcttcaccatttcattgtatacatcgataaaagtatgaaatgtttgttttgcctcatgctgaaaatgaatgtccagaatagatgcaacagtaaagcggtggtgtgaattgagtgttgagaagctgccgatgtttgatttgatatagctgctcaaatcataaaagcgctgaaaatcaaactctcttttattcacaatatatgcagaagaaatgagcattaatatctgatcgtgtgaaactttccattttaattttgattttaattcagcataaatggaaatgtattgctttattttttcatgtaggttgtgtgtcagcataaaaagcagctcctttttgctgtttttacgtaatacgataaatagggccaaaggtttcataaagaaaaaacttgcctgctagaggcaagtttgtcggattatttatggggatctgttatatccatcggtctcatcatgtcatagtcttcatgctctagaatatggcaatgccatacgtatcgtccgctgtacggaccgaatgtcgccgcgattctcaggacttcacctgcatgcgcttgaatggtgtctttccagcccttttcacttggcggcggcgggacagccggaccggtataggacaattccccgctttcttgataacgggcgatatcaaacggccgccggtctaatacacggaaggagactagatgcaggtgaatcggatgtgttccgcgtgttgggttgataatggaccatatttcagttgtgccgacttttggtgcttctgtgacgggatcgtgccagcgtttgttattaagcagaaggacgggtctgccgtattcgtcctgggtgcctgccagttttaacgttctgatgttttgtattctttcatgctgtaccgaagggtatgaggcgaggtacttcggctttctgctttcgtctttttgtgccaatggttttgtgactctgaattgcatgatattcgcatctgtttcaggattgacgtcaccgccgcagcccgcgctgtttgccaaaatgatcgattctccttcatatgctgtgaagtcaatgatgatatcataacgttcagcaggcgcaaggctgaaagaattcagtttaacagatcgcggcaggagccctccatctgaaccaacctgaataaactctccgccattatcgagtgacagattataggttcttgtattggaggcgttgatgacacggaatcggtatttccttggctcgacttccaagtatggccataccttcccgttgacgagtatggtttctccgcaaaaagccggaacgattgaaggattaggcagtgacggagaagggttttccggtgcgctcggataaaacaaagaaccatcctcattgatcgtgcggtctgtgataagaagcggcacatcgtattcgtctgaaggcagttttaagcgtttttcctttgggtcatgaatgatataagcaccgacaagtccggcatagacatttagcctggtgagcgccatggcgtgatcgtgataccacaatatagccccgcgctgctggtttggataatgataaacctctcttttgaaataaggtcctgtttgttcaaagtctttggaaaaccaagcctccggatacccgtcactatcatctggcgtgacgccgccgtgtaaatgaacaacagtctttacctcgggctcttcatgctggctgtcactgtgatgaatggtgtgatcaatcggaaggaaatgcgtggaaggaaggttattcatccattttacatatacgttttcatttcttttaacctcaatggtcggccccggaaataagccgttgtagccccacaggcgggttggagggagatcgcgatggagctgatgggtgcattcctccatggtgacttcgtagtatgttttttcttttgattgctgtactggctttagtgtatctgggattgggagagcatccacaaatttttcaagtgtcattttcatctttccttatctaaattttccaaattggtactatagttaatgacaataaggacgtgatggttacaaaaaatcttcgtgctgcagaccgcccgaagaagaaaataacaaaatcctaaacggcaggccgtttaggatttgatcagcattaaggcaggatatcgggctgctgctgtgtgactgggttggcagccgctttctcgctcaccttgcgttttctgaacacaaggtaagaaatcagaacgattcccgtgatgacgcctgtcagcagcagctcgtctctcatggaatcaataaacgccatggacactaaaattccgcaaatggcgaggatggtcaagtaggttaggaaagggaagagccacattttgatcttcaatgcttctgggtttgttttttcgagttttttccgcattttcagctgggaaactgcgatgacaagatagacgagtaaagcgattgcgcctgatgagttgactaagaataaaaagacggtatccggtgaaaaatagttcattacgaccgcgatataagagaaaaatgtcccggccacaatggcttgtacgggaacgccttttttgctcaatttcataaaacggcgcggcgcttcgtttctttctgcaagtgaatacagcattctggatgtggtgtacaaacctgaattcaggcaagagagtacggctgtgaggacgataaagttcataatctgtgcggctgcgggcactcctatatgctcaagtacagcgacgaaagggctttctaaaatatttgctgaattccatggcaacagcgccacgacaatggcgattgagcccacgtaaaagacgatgatgcgccatacaacggatctggtggcttttgtcacagattcgatcgggttggatgtttcccctgctgcaatggcaacgatttcagttcccataaaagagaagatgacaacgacaatgccgagcaatacggagctgatgccctccgggaaaaatccgcctttgcctgtaagattcgaaaaaccgactggctcactgcccggtgcaaagccaaaaataaaggcaaaaccaacgattagaaaagcaatgatagtcacaactttaatgagggagaaccaatattcaaactcaccgaaagacttaacggagtagacgtttgtcagggtgagcacaatggtcaagatcaaacttgtcagccacagcggaatatcatggaaccagtattgaataatgccagcaccggcaatggcttcgatcgcgatgacgatcacccagaaaaaccagtacagccagccgattgtaaatcctgcccacggtccgatggcgtcgtgagcgtattgagaaaacgatccgctcgtcgggtttacggcagacatctcaccgagcattctcataataaaaatcaccaataatccggctaacgcgtaagaaacaacggcacccggaccggtcgagtgaatcactgaaccgctgcctacaaataggccggctccgattacaccggcaatcgaaatcattgtcatatggcgggtctttaattccttttttaatcctgattgagactggttcataagttacctccttttaaaatgcaatcattactgaatattatgataattgaaactctatcataaatatacagtttgtcgaaaattcgtgtaagaaaatataccagcttatttcaaatttgtagtgttttgtttgcgctttcagcgaatgtgtggaaaaaatgtttcgttttttatttgctgtgtgattttgtgtactatttacaattcgatagaatgcgagaagtgctggtattattggatctgatgggctttttggcggagcaaataaattggatgagagaaaaagtgttccatcgtcactatttttctgtggcgggtgaatcatgtttctgtagacccactgcggatcagctttgtaagataataataggaaaatgtgagcggggaggaggttttgtatggagagatatgatgaactgaaaaagggagaatccggagcgctggtcagcattgccgcgtatctagttctttccgcaattaaactgatcatcggttatctttttcactcggaagcacttacggcagacggattaaataacacaactgacattattgcttctgttgctgtgctgattggcctgcgcatctctcaaaagcctcctgacgaagatcatccatacggccactttcgagcggaaacgattgcatcgcttatcgcatcgtttattatgatggttgtcggcctgcaagtgctgttcagcgccggagaatctattttttctgctaaacaagagacgccggatatgattgcggcttggacggcagcgggcggggcagtcctgatgctgatcgtttaccggtacaataaaaggctggccaaaaaggtgaagagccaggcgctccttgctgcggctgctgataataaatcagacgcattcgtcagtatcggcacatttatcggcattgtagctgctcaattccatcttgcttggattgatacggtcactgcgtttgtgatcggtctgcttatttgcaagaccgcatgggatatctttaaagagtcatctcactctttgacagatggattcgacataaaggacatttccgcttataaacagacaatcgaaaaaatctccggtgtgagccgtttaaaagacataaaagcaagatacttgggcagtacggttcatgttgatgtggtggttgaggtatcggcagatttaaatattacggaaagccacgatatagccaatgaaattgagcggagaatgaaggaggagcatgcgattgattattcgcatgttcatatggagcctttagaacacaaataattgagcttcctgccacaggaagcttttttgtgtgttttggccagctttattggaaacaatttgctagaatcgtttttttatacagattgctttttgtggtaaagttaggttacattatgatgaattttgtagatgattaggaggaaaagaatggcatatcaagaagacctgcatcctttgctggggaaagcagttgaacatattaatagagtaatggttggaaaacgagacatcgccatactcagcttagcagcccttcttgccaaagggcatgtgctgcttgaggatgtacccggagtcggaaaaacgatgatggtccgcgcgctggcaaagtcaatcggcgctgatttcaaaagaatccaattcactccggatttgctgccatctgatgtaacaggggtatctatctataatgcgaaaacgatggaatttgaatatcgtcccggcccgattatgggaaatatcgtgctggccgatgaaatcaaccgtacctctccgaagacacagtcggctttgctcgaagcgatggaagaggggagcgtcacggtagatggccatacgatgcagcttgccgatccgttttttgtgatggcaacgcaaaacccggtcgaatatgaaggaacctatcctttgccggaagcccagcttgaccggtttttattcaaacttcggatgggttatccgtcctttaatgaagagcttgacgtcttatctcttcaggaaaaaagccatccgattgagacgcttgagccggttattgcaaaagaagacttcatctttttacagagggaagtgcaaaatgtccgtgctgatgacagcattaaggaatatatcgttgaaattgtgcagaaaacgagacagcatccttctgttcaattaggcgtcagtccgcgcggctcaatcgccctcatgaaagcggcacaggcatacgcgctgctgcatcatcgcgactatgtcataccggatgatattcaatatttagctcctttcacgctgccgcaccggatgatgcttcatcctgaggcaaaatttgaagggattcaggcagaagcgatcgtaagggagatcatgtcagctgtgaaggtgccggttcaaaggtcgtcggtccgctgatgaataagaaatggcaatggctcgtatatggttggaagctgattatattaactttattgacggctgctgttttttcttatgcgatgtttcagggcggctttgtcagctggtttttgttttacgcgtttctcccttttgtcttgtatgccgggctgttggccttgtatccgctccgttcttttcaggcttcaaggcaaatggataaaacacaattgcatgcgggggacaggctgggcgtaacggttacgctgagaagaaagctgccatttcccctgatgtatatggtgattgaagattgcctgccagaaggtatcgagtcattaaatcgagacggagccgcggccaaacggctcgtttttccttggtttaaacggagcataacgatgtcgtatgaattagctcgggtaccgcgcggagagcatcactttcattctgtcagggtgcgaaccggggatgttcttggcttgattgaaaaaactgcattttttgagctggatgataccctgtttgtttatccattctatcagcgtttttcctatcaggtgaatgagaggcatcaggaagacggtgtaagcggttcttctccaattcatgagcaccattcctcagtcgcagcaagtgtgcggatttatcagccgggagaccggtttgctgcgttagattggaagacatctgcacggcggagccagctgatgacgaaggaatttgagccttctcgcagcaaaaatctgtttctgctgatggaccgtttttcctcagacgcattcgaagaggtcgtttcagtgacagcttcgattcttcattctgttttaaaaaacggcgagggcgctggcttggcttccatcggaaaggaaaaaaacattttccctattcaggaaggggatcagcattttaagcacatgcttcggcatttagccatcgctcattgtgatgcggcagacccgataagccgatatgcacgggaagagctgggaaagccatctgttcgccaagctgatcaagttgttgtcacgggacagttaacggaagatatgctgcacctcgcagaaataggaggcggccgggttacggtgatactggcaaaagagaaagatgctgagctctctcaagctgaaaatgtcatgattgaacgcatgatgaaacgccaaatcagagttcgggtcatgaggggcgggcgagtttcgcgtgttgtttagaaagagaggtgactggttcacatgccgcacgatgatcacaagggaagccgtttgagcttgctgttattttattttctggcttttttattgctgtgggagtggctcaggccgcttgacagttttactgaaacgaaacatacaggcttttttagtgtctttatcggcttgacgtttctgctgacttttttcaggatgaggtggtttgtcaccgttcctttttgtgtcatatttacattgatctcgatacacatcctgttttatcaaggatctatattcgacttgagctgggtcagctcttttttgcaggatgtctatctgaatatcacgctgattcaatcagggcaatggaatgacatgatcccttcatttcggaccctgctgttttttgtgctgctgtggctgctggtctatctcctgcattattgggtgatttaccagagaagaattttgtttttctttttgatgacagtagcgtatattacgattcttgatacctttacgccatatgatgccacttttgccgtcatccgtatcgtgctgatcggcttctttatgctgggccttttatacttggaacgcattaagctgatggaaagaatcacactgccaaaaacatctgtcctgaaatggtttcttcctttatctgtattggttttggctgcaacgggattcggactcgccgctccaaaatcagagccggcctggcctgatccggtgccttttcttaaaaaaatcactcatcaagaccgcgtgtctgcaggggaaagcaaaatcggatacgggaatcatgatgaatcactcggcggcccgttccagcaggatgctacacctgtttttacatggcagggaaaagagcgtacgtatttccgtgtggaaacgaaggacacgtataccggaaaaggctggattgaaacagacacaggcatgtcgtatcagcttagcaatggaaaagttgaaaatctgtggtttgaccataaggttgcgacagagcgccgcaccgtccgtgtaaaagtcgataagcactacgggtataaccatttgatgtatccgattggtgcggaaaccattcagccaaagcaggctgtctcacttgaaatgaacggcaacacggagcaaatttctccgatcagtgaacaagccggtgaaatcagaaatatggggaattatactgtaacgtacaattccccggtctataagctggatgaactgagaaaggtaaaagtgagaaaaaacagtgaggagtacacattcagcgatcgctacatgcagcttccagattcactgccagagcgggtgagaacccttgcgatcaaactgactcaggatcacgacaatatgtttgataaggtgaaagcggttgaggactatttagggtcaaatgcgttcacctatgaaacagaaaacgtgaccattcctaagaatgatgaagattatgtcgatcaatttctctttgaaacgaaaatgggttattgtgataacttttcttccgccatggtggtgctcttgcgctcggccggcattccggcccgctgggtaaagggttatacgtccggcgaatacaaagaagcagggaacaaaaatggcagcatttatgaagtgacaaataacaatgcccattcctgggtagaggtgtatttcccggaacagggctgggttacatttgagccgactaaagggtttacaaatccggctgaatttacttcttctgacacaaaggactccggcagcgataacagcagctcgccgaagaaagcacaagagaaacagaaagaagagaaaaaacagccgcaaaaagaagaaaaacaaaaggaaaaacgggagccagctgtttctaaaaagccgtccgcttcacataccaatgccggtgcgggcttgtatgcagcgcttgcggttcttgcagtcctcctggtggcagctgtattgctgtatgttttccgctcgttatggattcctgttttcgccgtgaggaaattgaagcggcgcagcgatcagcacgcgttttttgaggcatatgacgcgctgctgaaacaactgaagagaaaagggctgccgaaacgaggcagtgaaacgctgcgtgattatgcaaaacgaatcgatgaaaaatacgacatagaagacatgtcaaagctgacattaagctatgaaagggcgctttacagaaatgaagattcttcagcgctttggaatgattccagagagttatgggaaaatttaattaaaagaagatggtcttgaccgcttatcaacgtgttgttagaattagtgaatattatcggagtctgggagcgagttggcctgactccggcaaacggccttgccaaagagggcggagcgagcttcatatctgtcctcgtttttttctgtgtcaaaaaacttagaggagattaggtgacaaccatgacaaagttagtgaatgaaatgattcttgtccttgatttcggcagtcagtataaccagctgattacacgccgtatccgtgaattcggtgtttacagcgagctgcatccacatacattgacggctgaagaaattaaaaaaatgaatccaaaaggaattattttatccggcggtccaaacagtgtgtatgatgaaaactctttccgctgtgacgagaaaatcttcgagcttgatattcctgttttgggaatttgctacggcatgcagttgatgactcattaccttggcggtaaagttgaagcagcaagccagcgtgaatacggaaaagcaaatatccgcatcgaaggcacacctgatttgttcaaagatcttccaaatgaacaagtggtttggatgagccacggtgatttggttgtagaagttcctgaaggcttcactgttgacgcgacaagccatcactgccctaactcagcaatgagcaaagcggacaaaaaatggtacggcgttcagttccacccggaagtgcgccactctgaatacggcaatgatcttctgaaaaactttgtattcggtgtttgcgaatgcgaaggcgaatggtcaatggagaactttatcgaaatcgaaatgcaaaaaatccgtgaaacggtcggagacaaacaggttctttgcgcgctaagcggcggcgttgattcctctgttgttgctgttttgattcataaagcgatcggcgaccagctgacttgtatctttgtagaccatggtcttctccgtaaaggcgaagctgagggtgttatgaaaacattcagcgaaggctttaacatgaatgtgattaaagtagacgcaaaagatcgattcttaaacaaactaaaaggcgtttctgatcctgaacaaaaacgcaaaatcatcggtaatgaattcatttacgtgtttgatgatgaagcggacaagcttaaaggcatcgactaccttgcacaaggtacgctttacacagatatcatcgagagcggtacagcaacggcgcaaacgatcaaatctcaccacaatgtcggcggacttcctgaagacatgcagtttgagctgatcgagccgttaaacacgctcttcaaagacgaagtgcgcgcgcttggcacagagctcggcattccagatgaaatcgtatggcgtcagccgttcccaggaccgggcctcggaatccgtgttcttggcgaagtaacagaagaaaaactggaaatcgttcgtgaatcagatgcaatcttgcgtgaagaaattgcaaatcacggcttagagcgtgatatctggcaatacttcactgttcttcctgacatccgcagcgttggtgttatgggtgacgcaagaacatatgattacacaatcggaatccgcgccgttacatcaatcgacggcatgacatctgactgggcgcgtatcccgtgggatgtgcttgaagtcatttcgacacgtatcgtaaacgaagtgaagcacattaaccgcgtggtgtacgatattacaagtaagccgcctgcgacgattgagtgggaataagtaaataacaaaggaaaaacgtccctttcaaaaggggcgttttttttgttaactttttgaaaccgtttcgacagttttcgtatctaacaacataggaggtggataaggtgaaggaagaaagattgattacaaaggcgagaaaaggaaatgctcgggcctttgaaaagcttatgctggcacatcaggagactttatataaaacagcttatctctatttaagaaataaagaagatgcacttgatgctgtacaggaaacagcttataaagcttttatcagtatagaaaaactaaaagagccaaagtattttttaacgtggcttactcgaatattgattcataccatttttgccatgaataaaaagaaaggagatttggttccgtttgagaaacatcatgatgctggaactaatcaagcaaatattgaggaatacatagacttgcgaaatgcgattgatttacttgatgaacatgttcagctcacgattcagctctattattttcaagattattcaatatcaatgatagctgaacaaacaggtatggcagaaggcacaattaaaacccatttacatagagcgagaaaagcattgaaacaggagctggaaaaggaggatcaaaacaaatggacaaacaccaagtgaagcagatgtatgatgacatagcagtgccaaagaaagcactcaaaaaggcaatacatcaagctgtcgttcgtgctgaaaatgaaagtaacacaaggcgccgttttaaatgggcacgaactattacaaatggaatggctattgctgctgtggtatgtatattgtatttatcatctggtctttttcttccctctgtaaacaaagcgatggggagcatacccattgtcggacaaatttataaggattttcaagataaagttggtctatcattgtttaaaagcaatttggtcacagctttaaatgaaaaagcagactccaggggaatcactgtttatgtaaacagctcctattacgatgccggacagcttgtttataacttcactgttgataacttccactctgatgaaaaagagatcatgtatgatgtcgacgaaacgagttatagcgacaacttttcaatcaactacgattccttaatgcttaaaaaattaaataacaagcaatacgcaggacaattaaggatttatacaaatggtactgaaataaaaaatggggaaaccgtgccctttgtaattactcatatcaatgaaatacagggaaattggagattcaaactgcctattaccaaaaagaatgcgggttatttagaaagctcaaaagttatatcggcttatcataatcgttatcaattttccaatattcaagtggaaaacgggaaacttggatctgtccttcaatttacaatcgattatcaaggcatagcaaagcatgatacggttgaaattaacgaagttaaagatgatttaggaaacacatatgagatgtcagcatcaaacatcgaacttggagatcgcataaaggtaaacgagagaacggtaagagcaaaaggacaaacacagttagaatcaccaatcaatccaaaagcgaaaaagctaacattaattgcagatattagatctgaggctgagggcagtgaaatcgtccctctaaatgcagagatgccgtatcgtctttcggaaacaaagcatcaaaacatagggatagaaatcaataacattaaacaagaggggagggaagtattggttcattaccgtttcactggagttgatacttcaaatatgtcaaaagatgacttagtgaatataggtgaaatgattggccttggtgatatgaaaaaaatgcaatcatggtctgatccaatggcttattatgaagaaggttattatttgaaatggaataaagctgaagtgaagaatatggacacagccgaaatgttatcaacttttgaactggatgacgcttatcttgataagctgtctttaaagcattttgagtttaatgaatacggtctgtatattgataaaggcgttttaaatgacctgattcaactaaagccattctcgtttactgtaccagtgcatcaggtgagtcagccttcaagataaaataatcataagttgaaaagccgtatgaagtcatgcatacggtttttatcattgttgccaatttagtcaatagacgaataaaccaatttttttaataagtaatgttcgttgtttatattgtcaattcaaaatgaagttggtacaatagacacagaaatcaaataagatgaattcgtataatcgcgggaatatggctcgcaagtctctaccaagctaccgtaaatggcttgactacgtaaacatttctttcgtttgatataaataaaacacgtttatttattcaaactgaaatccgtctgtagtcaagcgtcccaaaatgtattggggcgttttttatttggcgttttcaggacagaataaatagcaaagagtgaagggagtcaaatagcttgaaaacgttttttcagtttgatgagctgggcaccagctatcgcaatgaaatcattggcggattaacgacttttttatctatggcatatattttgttcgtcaatccgattacgcttgctgtggagagcgtgaaagattttccggaggcgctgagaattgaccagggtgcagtctttacagcgacagcgctggcgtctgcagcaggctgtatcttaatgggattaatagcgagatatccgattgccatcgcgccgggtatggggctgaacgcgttttttgcgttttctgttgtccttggtatgggtatttcatggcaggcagctttgtctggtgtttttatttcaggtcttattttcgttgctctttctttaacaggttttcgtgaaaaaatcatcaacgccattccgcctgagctgaaattggcagtcggtgcggggatcggcctgtttattacattcgttggtttgcaaggctcaggaatcattactgcaaatccttctacgctcgtcacgatcggaaacattcacagcggtcctgtgctgttaacgattttcggtgtgattgtcacggttattttaatggtgcttcgcgtgaacgcaggcgtgtttatcgggatgttattaacagcggtagccggcatgattttcggtttggttccggttccgactcaaattgtcggcagtgtgccaagccttgcgccgactttcggacaagcgtggattcacctcccggatattttctctgtacaaatgctgatcgttattttaacattcttgtttgtcggattttttgatacagctggtacacttgttgctgtggcgacacaagctggtttaatgaaggaaaacaaattgccgcgtgcgggccgtgcgcttttagctgattcatcttctattgtgatcggtgccgtgcttggtacgtctacaacaacttcttatgtggaatcaagctcaggtgtcgctgcgggtgcccgttcaggatttgccgcaattgtaacagggattctctttttactggctacgtttttctctccgctcctatcagtcgttacgtcaaatgtaacagcgccggcgcttattattgttggtgcattgatggtggcgccgcttggcaaaatcgcttgggataagttcgaagtggccgttcctgctttccttaccatgatcatgatgccgttaacgtacagcattgcgactggtattgccatcgggtttattttctatccgattacaatggtgtgcaaaggaaaagccaaagaggttcatccaatcatgtacgggctgtttatcgtatttatcctgtactttatcttcttaaaataaggaatgaaaaaccagctgcacaggcagctggtttttttgttgcaaaagataaaaccatttcatacgatataccgtcatgtagatgtgccgccatgctttacttaaatggaaatgacttgactgttcaggaaggcttcggtaccttatataagtgttttattttcttgctgaatggtattccgccgtatttttttgataggagttgctgacatgacggaagaaagaaaagaaacgtttgaagaagaaattaaccagagtgaaagaatagatgcagatgaagaaccgctatcgagaatgtccagaaaggcgagccggcaaagcaagcagaagcaaaaacaaaagcagaaaccgcgccaggaacgcggtgaatcaactgttaaagacaagcttgcgtctgtttgggcagccatcaacagatattgcggatttgcgttctcgattttaaaatctccggcgaaaactgtcgtaacggatggtttttctcattataagtacggtctgatttcaatgcttatattcagtatcattttttcaattgggaattggtttcagttaaaggcaagctggaatcggccgctcggtttcggagaacgccatcatgctttctatgacgggtttttagttgttcttgtgtatttgctgatctttttcgcggtaatggtctttgctatatgggctgtctcccgctatatgatgaagcagaaggtgacgttcagagaagcagctgccgtattgggttcattgcttgtaccggtaattgctgtttcaatcctttggctgatctttgcgatcgtaaatatcccaatgctgacagtactgtttacggtgctgatcttgttttccatcttttttatcatcgcgctgtatgtacagcgtgtgtaccaggcggcacaagatgcaccaattgattatatctattgtgtatttgcagtggttgcgatagcgctgctgtttacggcagtgacttggccgtttatttctgaatattttacggcgtcgctgattccgctttaatgaaaaaaccggctaatcctagccggtttttttatgtcacactttttacaaatatatctaaaaaacatagttgatttgtaggattaacccgtgtatgatggggaaaatgctgaaaacgtccagcgcaaaaacctttatgtttaaggaggatgatggacatggctgatgtgcttcgccgagcaattaaccaaaagaagcaatttttaaaaaccaaattactgctctcggaattttatcaaggaagaggggaacagcttgctgactacacgctgagtgagcttgagaaagaatacaagtcccttcagaaaatgaaaaaagagatctgacaatagatataaagaggtgagtctgctgaaaagcgggcttttttgttttgattttgaaaaggcgagaaagagggtaaactactactgttcaacacataaaagcatgtcgaaatattttgcttaaacttacgggcgaagctgattgtaaacggctcatttctctagtagaatatgaatgctttgtgcaagctgaagagtagggggatgaataaaatgatgcaaaccatcttatcaaatgggatagccatggttctcataattctcattattaatattgtctatgtgtcattttttacgataagaatgattttaacgctgaaaggacagcgttatttagcggccggcatcagtacgattgaaatactggtttatgtgacagggctgagtctggtgctcgataacttagaccagattcaaaatgtgatcgcgtacgcgctcggttacggtctaggcgtaattgtcggcatgaaaatagaagaaaaattggcgcttggctatattatggtcaatgtgattacaaaggagctcgatcttgatcttccgaagcagctccgtgaaaaaggctacggcgtgacaaattgggtggcaggcgggcttgaaggcgaccgcacagcccttcagatcctgacgccgagaaaatatgaactccagctatatgatacgattaaaacacttgattcaaaagcctttattattgcgtacgaaccaaaaacaatccacggcggcttctgggtcaaagcggtgaagaagaggagaattaaagaataatggcaaagccgaagaagaaaaagtttgaagtgacagagcagcaaacgatcgatgcggtgcttcagcaaatgaaagaagaaggatatctgcctgtaaggcgaatggaagagcctatttttatggaaaaaaaggaaaatgggtcaattcagatcgttccgtgcgggaaaaaaatcgtatttgaagggaaattgatctaaaacacgaacattagtagaatgaatttttgtatcgttcgataatatcgttgacattatccatgtccgttgttaagataaacatgaaatcaaaacacgacctcatataatcttgggaatatggcccataagtttctacccggcaaccgtaaattgccggactatgcaggaaagtgatcgataaaactgacatggatatatcgcagaagcgaacgactgacgatacatgtaccatgcccggtttgtattgcttcctcataagtgcaatgcagagcgggtattttttattttctgaaaacaaaagcattagaaggtggggaacagaatgcagccgctagtaggaatcatcatgggaagcacttccgattgggagacaatgaaacacgcatgcgacatacttgacgaactcaatgttccgtacgaaaaaaaggtcgtttccgctcaccggacgcctgatttcatgtttgaatatgctgaaactgctagagaaagaggcatcaaggtgattattgccggtgccggaggagcggcgcatctgccagggatgacggctgcgaaaacaacactgccagtcattggagttccggttcagtccaaggcgctgaacggaatggattcacttctttccatcgtccaaatgcctggaggcgtgcctgttgcgacaacatccatcggcaaagcgggtgctgtgaacgcaggcctgttagcggcgcaaattttgtcagcatttgacgaagaccttgcccgtaagctggatgagagaagagaaaatacaaaacagacagtgttagaaagcagtgatcagcttgtctaaacaaatcatctatccgggagctgtaatcggcattatcggcggcggccagcttgggaaaatgatggctgtgtccgccaaacaaatggggtataaagtcgcggtcgttgatccggtgaaagattcgccgtgcgggcaggttgcggatgtcgaaattaccgctcattataatgaccgtgaagcgattcgaacattggctgaaatcagcgatatcatcacatatgagtttgaaaacatcgactatgatgcgctgcattggctgaaagatcatgcgtatctcccgcaaggaagtgagctgctgctcattacccaaaaccgtgaaacagagaaaaaagcaattcaatccgcgggctgtgaagtcgcaccgtacagcatcgtcaaaacaaagaatgaattgacacaggcggtacaggagctcgggttgcccgcagttctgaagacatgccgcggcgggtacgacggcaaaggccaatttgtgataaaagaagaggcgcaaatggagcaggcagctagtctgttagaacacggaacttgcattcttgaaagctgggtttcttttaaaatggaactgtcggtgatcgtcgtcagatcggtaaacggtgaaatttcaacatttccgacagctgaaaacattcaccacaacaatattcttttccaaagcatcgtgcccgcacgggtagagaaagggattcagcagaaggctgctgatctcgcggttaagcttgcagatgagcttaaccttgttggaccgcttgctgttgagatgttcctgacagaggacggagagcttttggtcaatgaactggcgccaagaccgcacaattctgggcattatacgctggacctttgcgagacgagccagtttgagcagcatatcagagcggtatgcgggcttccgcttgggaagacagatttgctgaagccgggcatgatggtgaatcttctcggcgatgaagtaaagcttgttgaggaagacccggagcttttaaaagaggcaaagctatatatatacggaaaacatgaaatcaaaaaaggccgcaaaatggggcatattacatttatgaagcagcctgaagacgaatggattcaggagatcacaaataaatggatgaatagagatggaggacaagcagaatgatcgaacgttattcaagacctgaaatgtccgcgatttggacggatgaaaacagatttcaagcatggctggaggtagagattcttgcctgtgaagcgtgggcggagcttggcgtcattccgaaagaagatgtaaaggttatgcgtgagaacgcgtcatttgacatcaaccgcattttagaaatcgaacaggacacgcgccatgacgttgtcgcttttacacgcgccgtttccgaatcactgggcgaagaaagaaaatgggtgcactacggattaacgtcaactgacgttgttgatacggctctttcctacttattaaaacaggcaaacgatattctgctcaaggatcttgagagatttgttgacattataaaagaaaaagcgaaagaacataaatacacagtcatgatggggcgcacgcacggcgtacacgctgagcctacaactttcggcttaaaacttgcgctttggcatgaagaaatgaaacgtaatcttgagcgttttaaacaagcgaaagcaggcattgaggttggaaagatttccggcgctgtcggcacatatgcgaacattgatccatttgttgagcaatatgtctgtgagaagctcggattgaaagcagcaccaatttccactcaaacccttcagcgtgaccgccatgctgactatatggcaacacttgctttgatcgcgacaagcattgagaaattcgctgtggaaatccggggtttgcaaaagagtgaaacacgtgaagttgaggaatttttcgcgaaagggcaaaagggttcatctgcaatgccgcataaacgaaatccgattggctctgaaaacatgacaggcatggcgcgtgtgatccgcggctacatgatgacagcttacgaaaatgttccattatggcatgagcgcgatatttctcactcttcagcagaacggattattcttccggatgcgacaattgcgctgaactacatgctgaaccgcttctccaacatcgtgaagaacttaacggtcttcccggaaaacatgaagcgcaacatggaccgcacactcggccttatctactctcagcgcgtgctgcttgctttgattgacacaggcctgactcgtgaagaagcctatgatacagtgcagccgaaggcaatggaagcgtgggaaaaacaagtgccgttccgcgagcttgtggaagcggaagagaaaatcacgtcacgtctttctccggaaaaaattgctgactgctttgattacaattaccatctgaaaaatgttgatctgatctttgaacgtttaggtttagcatagaagaagcttttagcggcttcttctaagccgccgcagtttgaaaattcccaacattcgggttaggaggccttccgtgaatattgtgaagaatgaacttttatacgaaggaaaagcaaaaaagatctacaaaaccgatgacgaaaacatgctgtatgtcgtgtataaagactccgccactgcctttaacggcgagaaaaaagcagaaatcagcgggaaagggcgcttaaataacgagatttcaagcttaattttcaaacaccttcatgcaaagggcattaacaatcattttatcgagcgcatttcggaaacggaacagctcattaaaaaggtaacgattgtgccgcttgaagtcgtcgtcagaaatgttgtggcaggaagcatgtccaaacgtctcggcattccagaaggcacggagcttgagcagccgattatcgagttttactacaaggatgacgcgctgggtgatccgctcatcacagaagatcatatttggcttttgaaggcggcgactcctgagcaggtagaaaccattaagtccattacaaaaacagtaaatgaagagcttcaaagcatcttcgacgattgtcatgtcagattaatagatttcaagcttgaattcggtttagatgcagaagggcaagtgcttttggcggatgaaatttctcctgacacatgccgcttgtgggataaagacacgaacgaaaagctggataaagatttattcagacgcaatctgggaagcttaaccgacgcatacgaagagattttcaaaagactgggaggcattcatcatgtataaagtaaaagtttatgtcagcttaaaagaaagtgtactagatccacaagggagcgctgtccagcatgccttgcacagtatgacttataacgaagttcaagatgtgcgcatcgggaaatacatggagcttaccattgaaaaatctgaccgtgatcttgacgtgctagtgaaagaaatgtgcgaaaaacttcttgcgaacacagtgattgaagattacagatacgaggttgaggaggtagtcgcacagtgaaatttgcggtgattgtgttacccggctccaactgtgatatcgatatgtatcatgctgtaaaggatgagctcggccatgaagtggaatacgtctggcatgaggaaacaagtcttgacggcttcgacggcgtgttaattccgggaggattttcttacggcgattacttaagatgcggcgccatcgcccgatttgcgaatattatgccagctgtcaaacaagcagcggctgaaggaaaacctgttcttggcgtctgtaacggattccagattttacaggagcttgggctgctgccaggcgcaatgagacgcaacaaagatctgaagttcatttgccgtccggttgaattgattgttcagaacgacgaaacattattcacagcttcctacgaaaagggagaatcgattacaatcccggttgcccatggtgaagggaatttctactgtgatgacgagacgcttgctacattaaaggaaaacaatcaaattgctttcacatacggctctaatattaatggaagtgtcagcgacattgccggtgtcgtgaatgagaaaggcaatgtattaggcatgatgcctcaccctgagcgcgcggtcgatgaactgcttggaagcgccgacggtcttaaattgttccagtctatcgtgaaaaattggagggaaactcatgtcactactgcttgaaccaagtaaagaacaaataaaagaagagaaactgtatcagcaaatgggtgtcagtgatgatgagtttgcattgatagaatccattcttggaagattgccgaactacacagaaatcggaattttttctgtcatgtggtctgagcattgcagctataaaaactcaaagccgattctgcgtaaattcccgacaagcggtgagcgtgtgctgcaggggccgggggaaggcgccggaatcgttgatatcggtgataaccaagcggttgtgttcaaaattgaatcacataaccacccatcagctctagagccttaccaaggcgctgcgactggcgtaggcggaattatccgtgatgtattctcaatgggtgcacgcccaatcgctgtattgaactctcttcgatttggtgaactgacttcaccacgcgtgaagtacttgtttgaagaagtagtagcgggtattgccggatacggcaactgtatcggcatcccgacagtcggcggagaggtgcagtttgacagcagctatgaaggaaatccgctcgtcaacgccatgtgcgtcggtttaatcaaccatgaagacatcaaaaaaggccaggcgaagggtgtcggcaacacagtaatgtacgtaggagcgaaaacagggcgtgacggcatccacggcgctacgtttgcttctgaagaaatgtcagactcgtctgaagagaagcgttctgctgtccaagtcggcgatccgtttatggagaagcttttgcttgaagcatgtctggaagtcatccaatgtgacgccttagtcggcattcaggatatgggagctgccggtttaacaagctcaagtgcagaaatggcaagtaaagccggttctggcattgaaatgaaccttgacctgattcctcagcgagaaacaggcatgaccgcgtatgaaatgatgctttctgaatcacaagaacggatgcttttggttattgagcgcggacgtgagcaggaaatcatcgatatttttgacaagtatgatcttgaagcggtttctgtcggacatgtgacagatgataaaatgcttcgcctgacacacaaaggagaggttgtgtgcgagctgcctgttgatgccttggcagaagaagcaccggtttaccataagccttctcaagagcctgcttattatcgcgagtttttggaaacggacgttccggctccgcaaattgaagatgcgaatgaaacgctgaaggcccttcttcagcagccgacgattgcgagtaaagagtgggtttatgatcagtatgactacatggtgcgcacgaatacagttgtcgctcctgggtctgatgctggtgttctcagaatccgcggaacgaaaaaggcgctggcgatgacgacagactgtaacgcgcgttatctctatcttgatcctgaagtcggagggaaaattgctgtcgctgaagcagcgcgcaacatcatttgctcaggcgcagaaccgcttgcggtcacagataaccttaacttcggaaaccctgagaagccggaaatcttctggcagatcgaaaaagcggcagacggcataagcgaagcgtgcaatgttctcagcacaccggttatcggtggtaacgtatcgctttataacgaatcaaacggcacggcgatctatccgacaccagttatcggcatggttggcttaattgaagatacagcacacattacaacacagcatttcaaacaagcgggagatctcgtatatgtgataggcgaaacaaaaccagagtttgccggaagcgagctgcaaaaaatgacagaaggccgtatttacggcaaagcgccgcaaatcgatcttgatgtagagctgtctcgtcaaaaagcactgcttgacgcgattaaaaaggcttcgttcaatctgcgcatgatgtgtctgaaggcggcttaggcgtagcgattgcggaaagtgtcatgacgacggaaaaccttggcgctaatgtgactgtagaaggggaagcggcattattattctctgaatctcaatcccgcttcgtcgtttcagtgaaaaaagaacatcaagctgcgtttgaagcaactgtcaaagatgcggttcatattggtgaggtaacagctgacggaattctggggattcaaaaccaagacggacaacaaatgattcatgcgcaaacgaaagagcttgaacgcgtatggaaaggagctatcccatgcttgctgaaatcaaaggcttaaatgaagaatgcggcgtttttgggatttggggacatgaagaagccccgcagatcacgtattacggtctccacagccttcagcacagaggacaggagggtgcgggcatcgtagcgactgacggtgaaaagctgacggctcacaaaggccaaggtctgatcactgaagtatttcaaaacggcgaactcagcaaagtaaagggaaaaggcgctatcgggcacgttcggtacgcaacggctggaggcggcggatacgaaaatgttcagccgctcctcttccgttcccaaaacaacggcagcctggcgcttgctcataacggaaaccttgtcaacgccactcagctgaagcagcagctcgaaaatcaagggagcatttttcaaacctcttcggatacagaggttttggctcacctgatcaaaagaagcggacatttcacgctgaaggaccaaattaaaaactcgctttctatgctgaaaggcgcctacgcgttcctgatcatgaccgaaacagaaatgattgtcgcacttgatccaaacgggctgagacctctatccatcggcatgatgggcgacgcttatgtggtcgcatcagaaacatgcgcatttgacgtcgtcggcgcaacgtaccttcgcgaggtagagccgggagaaatgctgatcattaatgatgaaggaatgaaatcagagcgtttttccatgaatatcaaccgttccatttgcagcatggagtacatttatttctccagaccagacagcaatattgacggtattaacgtacacagtgcccgtaaaaaccttggaaaaatgctggctcaggaatccgcagttgaagctgacgtcgtaaccggggttccggattccagtatttctgcggcgatcggctatgcagaggcaacaggcattccgtatgagctcggtttaatcaaaaaccgctatgttggcagaacgtttattcagccgtcccaggctctgcgtgagcaaggcgtcagaatgaagctgtctgcggtgcgcgggttgtagaaggcaaacgcgtcgtgatggtggatgactctatcgtacgcggaacaactagccgccggattgtcacgatgcttagagaagcgggtgcgacagaggtgcatgtgaaaatcagttcaccgccgatcgctcatccgtgcttttacggcattgatacgtccacacatgaagaattaatcgcgtcttcgcattctgttgaagaaatccgtcaggaaatcggagccgataccctctcatttttgagtgtggaagggctgctgaaaggcatcggcagaaaatacgatgactcgaattgcggacagtgtctcgcttgctttacaggaaaatatccgactgaaatttaccaggatacagtgcttcctcacgtaaaagaagcagtattaaccaaataaaacttgaaaaatgacataaaggcagcgcagttcggctgcctttctctttctgccctcgttcggggaaatattttgaaaagcgccttaaaggagtgaataggatgtctgaagcatataaaaacgcaggagttgacatcgaagccggatatgaagctgtaaaacgaatgaaaaaacacgtggagcgcacgaaacggcttggcgttatgggcagccttggcggttttggcggcatgtttgacctgtctgagctttcttatcaaaaaccagttctcatttcgggaacggacggtgtcggcacaaaattaaagctcgctttttccatggataagcatgacacgattggcgtggatgctgttgcaatgtgtgtcaatgacgtgctggcacaaggtgcagagccgctgtttttcctcgattatttagcggtcggcaaagcggacccagtgaaaattgaacagattgtacaaggtgttgcggaaggctgtgagcaatcaggttcagccttagtcggcggtgaaacggctgaaatgccgggactctatacagctgatgaatacgatattgccggtttctcagtcggagtggcagaaaaggacgaaatcgtgactggagaaaatatcgaagagggccatctgttgatcggcctcagctccagcggccttcacagtaacggcttttcccttgtcagaaaagtgcttctggatgatgcggagctggaccttgatacaacatatgagccgtttgaacgcccgcttggcgaggaattgcttgaaccgacaaggatttacgtgaagcctgtgcttgccgcggtcaaaagcggaaaaatcgacggcatggcgcacgtgacaggcggaggatttattgaaaatattccgcgtatgcttccggaaggcttaagtgcggaaattgatcatggctcatggccgatcccgccaattttttctttcttgcaagagtacggcaagctaaaggaagaagacatgttcaacgtctttaatatgggtattggttttgttttggctgtcaaagaagagcatctgacagatgtgatcggaacgcttgaaagccatggcgaaaaagcctatttaatcgggcgtgtgaaaaaaggtgaaggcgtcacattcggcggtgcggcactttcatgaaaaagtttgcggtatttgcatcaggaaacggttcaaacttcgaagccatcgtcacgcgtttgaaggaggagaactgggatgcgtcagcagcgctcctcgtttgcgacaaaccgcaggcgaaagtcatcgaacgggcggaagcattccatattccttcctttgcatttgagcccaagtcttatgaaaacaaggctgcatttgaacaagccatcattgaacagcttcgtcttcacgaggttgaattgattgttcttgccggctatatgaggctgatcggtgatacgctccttcaagcatatggaggaaaaatcattaacattcacccgtcgcttcttccggcgtttcctggaatcgacgcagtcggacaggcataccgggcgggtgtgaaggtggctggaatcaccgtgcattatgtcgatgaaggaatggatacaggtccgatcatcgctcaaaaggcaatcgaaattgatgaacatgatacattggaaacaatcgaacagcggattcacaagcttgagcataaatggtatccgagtgtgattaaacagctattaggattaaataacagaggtgaaaaggcatgaccattaaacgtgcgttaatcagtgtttcagataaaacaaatcttgttcctttcgtaaaagaactgacagatcttggcgttgaagtcatctccacaggcggaacgaaaaagcttcttcaagaaaacggtgtggatgtgatcggaatttctgaagtgacaggcttccctgaaattatggacggccggttaaaaaccctacacccgaatattcacggcggccttctggcggttcgcggcaatgaagagcatatggcgcagatcaatgaacacggaattcagccgattgacctcgttgtcgtcaacctctatccatttaaagaaacgatttctaaagaagacgtcacgtatgaagaagcgattgaaaatatcgacatcggcggacctggcatgctgcgtgcggcatcaaagaaccatcaggatgtcacggttatcgtcgatccggccgattacagcccagtgctaaatcaaatcaaagaagaaggcagcgtatctcttcagaaaaaacgcgagctcgcggcaaaggtattccgtcatactgcggcatatgatgcactgatcgctgactatctgacaaatgttgtcggtgaaaaagaaccagagcaattcactgtgacatttgagaaaaaacaatcgcttcgctatggagaaaacccgcatcaggaagcaactttctatcaaacagctcttcctgtcaaaggctccattgcgcaagcagaacagcttcacggaaaagagctttcttacaacaacattaaagacgcggatgcggcagttcaaatcgttcgtgaattcactgaaccggctgcggttgccgtgaagcatatgaacccgtgcggcgtgggaacaggaaaaacgatcgccgaagcgtttgacagagcgtttgaagcggataaaacatctatcttcggcggcattatcgcgttgaaccgtgaagtggacaagacaactgccgaagcgcttcataacattttcttagaaatcatcattgcgccttcattcagccaagaagcgctcgacgtcctgactgcgaagaaaaatctccgcctgctgacgcttgacgtatctgctgctgttcaaaaggaaaaacagctgacatccgttcaaggcgggctattgattcaagatttagatatgcacggctttgatgatgctgagattagcattccgacaaaaagagagccgaacgagcaagagtgggaagacttgaagcttgcttggaaagtcgtgaagcatgtgaaatcaaatgcgattgttctcgcgaaggacaacatgacagtcggcgtgggagcaggccaaatgaaccgcgtcggatcggcaaaaatcgcaatcgagcaagcaggggaaaaagcgaaaggcagtgcgctcggatctgacgcatttttcccaatgccggatactgttgaagaagcagcaaaagcgggcgttacggctatcattcagccgggggatctgtgcgtgacgaggattccatcaaaaaagcggatgaatacggcattgccatggtattcaccggcatcagacacttcaaacattaaggggatgaaaacgacgtgaatgtattaattatcggcaaaggcggaagagaacatacgctggcgtggaaggcagcgcaaagcagtctcgtcgagaatgtatttgcagctcctggaaatgacggcatggaagcttccgcacagcttgtaaacattgaggaaagcgaccacgcagggcttgtctcgtttgcaaaagaaaaccaggtcggcctaaccattgtcggccctgaggttcctttaattgaaggtctggtggatgaatttgaaaaagcgggtctgcgcgtgttcggcccgtcaaaagccgcggcgatcatcgaaggaagcaaacagttcgctaaggatttaatgaagaaatacgacattccgactgcagaatacgacacgtttacatcctttgatgaggcgaaggcatatgtgctggaaaaaggtgctccgattgtgatcaaagcagatggacttgcagctggaaaaggcgttactgtggctatgacagaggaagaagcaattgcatgtctgcatgactttcttgaagatgaaaagttcggtgatgcgagcgcgtccgttgtcattgaagaatatctttctggtgaagaattttctctgatggcctttgtcaaaggggaaaaggtgtatccaatggtgattgcccaggatcacaagcgtgcgtttgacggagacaaaggcccgaatacgggcggaatgggcgcttactctccagttccgcaaatttcggatgaaacggtccgccatgctgtagaaacgatcgtgaagccggccgcaaaagcaatggtacaagaaggccgttccttcactggcgttttgtacgctggattgatgcttactgaaaacggctcgaaggtcattgaatttaatgcccgtttcggcgatccggaaacacaggtcgtgcttccgcgcatggaatctgatctggtgcaggtgcttcttgatcttttagatgataaggaagttgacttaagatggaaggataccgcggcagtgagtgttgtgcttgcttcagatgggtatccggaaagctacgcaaaaggcacgccgatcggcagccttgcagcagaaactgagcaggtcgtggtcttccatgccggaacgaaagcagaaggcggagagttcgttacaaacggggggcgcgtcgccaatgtgacagcttttgatgaatcgtttgaagcggctagagaccgagtgtacaaagcggttgatgaaattttcaaaccgggactctttttcagaaaagacattggggcacgcgctttaaaggctgctcaaaaataactgaggaaaacccgcagattagctgcgggtttttttgttatcaaaaagcgggatggcagctggaagaagaaagcacaacgagtgtggttggttttccatgggccatcgaggcgtcaataaaatcctcaagcgtatgtaccgattcagtcacgacctttgtcacatagctgtacatccctgtgatgcggtgattttctgctacatcaggatgcgatgttgcaaaggcggcgtagtgcttacagctttttggctccatgagaataaaagcggtgacatgcttgtttagtttttcgtaacagatattcgcgctgtagccggtaatcactcctttgtcttcaagcttcctgacacgctccgccgcgcttggcgaactgagtccgacaagctttcccagctcaaccatcgttaatctgccgtttcgctgcaaatgcgagagaatctgaaggtctgtatcgtccatttgtccggctcctttacatatttaggcgaatgaatgaaaattcctttgatcataaggcaatgctgttgacttaccttcattgtagcatatggatgccgtcttattttttctataataaagccatcaatcagagaggaggcatcatgttgccagaattacagcgctctattacttggatacaagggacggcgttaacgattggggcggttttaggatgcgggatattaattttgccgtctgttaccgcggatacggccggtccggcttctttatttgtctgggtattcatgtcttttttatcttttcttctcgtcggcacgctggcacggcttgtgaaaattgcgcctagtgcgggaggaatcactgcttatgtgcagctggcctttcagaaaaaagccggggctattttgggctggatcatgttagggtccgttccgatcggcgttcccatcatcgctttgactggcgcgcattacgtcagttacgtcacagaggcggccgattggcaggttacatcgattgctggttgtatgctggctatatctattttgcttcatatgaaagggattcaactatcagcaaacatcagtacactcgttatatgtgtcattgtatttctgcttgtcacttctattgctgtgtcattgccacacgtcacgatagcagaattcaaaccgtttcttccgcatggctggtctgccgcgggatctgtttctgttatgatttttttctcttttgtaggctgggaaatgattaccccattggctgaggaatttcatcgccctgaaaaagatgtcccgctcagcttgtttttggcagcgtcttgtgtggcagggctgtatatcatgctgtcatttgtgacggtggggactcattcatatggagagaatggagaaattgcatcgcttgccatgctcatctcaaaaggagcaggggaaagcggtgtatatgttacggtatgtttatcgctgtttattacattcgccaccatccatgccaatattgctggtttttcaagaatggtgtacgcattggcgaaagaggggtacattcctgtatattttggaaaactcagtgcgacaaaacgtacgcctattcgcgttttgacagcgatggccgcagtgtttggcttagtgcttgcggcgcatggtctgtttcaaatcgatttgacgactctgttgaaagggccgagcgcggcatttatcgcatcttacatatgtacaatggcggcagcactgaaactgctgggcaggagagatataggctggtggatggcgctcggggcatttgcggcgtgcgcggtgatttattcattcagcggctgggcactgctttatccggcagtgctggcagctgcaggatatttctatatgaaaacaaagggtgggcataaaaaaaagcttgatcacgttttgtgatcaagcttttccatttatccgttttgatgctcgttatttccagaatcactgtgttgaaacatgtaggtcacaggacagaagcgcaagattcccgaacccgctttcatggcccccataaagatgtaaaagagatgcattctgcaccaaggttttttcgtaaactttgcactggcggctgacataatcgtcaatccgcaggcgattctgaacacggcattgatgagactgatgtttggcttcaaggaaatccgctccttttacttaaaaaagttttttaaccgaaccttcaaaaatttgtaacgtttttatcgtgcgtgatgaggaaggatgtgataccatgagtctaatacatgtaaaggagagtatgtgaatgtccgaacgcacctttaactggaaaaacaaagacatcagggcacaggttgatgttgtagactcaaagctgcttccaacgctccttttacggaatgctctcgtcttaaatccatatgtaaaacaatggctgaaaaaaaacatttggatttatcaggaccgcattgtttatgtgggtcatgaacttccgaatagagccgaagaaattcatacgattgattgtgaaggaaaatacattgtgccaggttatattgaaccgcacgcacatccttttcaaatatataatccccaaacactggcggaatatgtgtctcaatacggaacaacgacattcgtgaatgataacttatttttgcttttgcaaagcggaaaaaagaaagcgcttacgattttgaatgaactcaaaaagcagcctgtccagtatttttggtggtcacgctatgacctccagaccgaggttctgaacgaggaccacgtccttccatttgacgtcagaaaacagtggattgaacatccggatgtgattcaaggcggagaaatgaccggatggcctcgcttggtagatggtgatgatttaatgctccactgcatgcaagctacaaagaaacagcgaaaacgcattgaagggcattttcccggcgcatctgataaaacgcttacaaaaatgaagctgttcggtgcggattgtgatcatgaagcgatgacaggtgatgaagtgatgagaaggctggaactgggctattatgtttcccttcggaactcttccattcgccccgatgtaagaaaaatcttgcaagagctgcatgagaagggcttccgttattatgaccacttcttttacacgacagatggcgcaaccccgaatttctataaaggcggcatgacaaacgagctgattcgcatcgctttagaagaaggcgtacctgcaatcgatgcctacaatatggcatcatttaatatcgcaaagtattaccaaatggatgattatttaggagttgtcggaccgggtagactggcatcgctgaacatattggaagatccgttaaatccgaatcccgtgactgttctgtcaaaagggaccattctgcgtgaagacggctgtgatttgaaggcgtttacaaagacggactggcacaaaggcggtcttgtcccgcttgagctttcatatgatatgacgatggatgacttgcagttttctatgccgatgggcgtgaaaatgcggaatgcggtcattatggagccgtatatgattgagatcgacaattcgatggaacagctctcgtttgaccatgatgaaagttatttgacgatgctcgacagacacgggaaatggcgcgtcaatacgatgataaaagggtttgcctcaagcgtgcagggatttgtaagctcctttacgacgacgggcgacattgtcgcgattggaaaaaataaagcggatatgctgctcgcttttgcccgcatgaaagaaatcggaggaggaattgttttagcggagaacggaaacattctgcatgaaatcccgcttgcgctgtgcggctgcgcctcttcggaagcatatgaagtcgtgcttgagaaggaacagaagctgagagatcttttgactgaaagaggctatgagttttgcgatcctatctatacgctgctctttttgcaaagtacgcaccttccgtatatacgcattacgccaagaggaatcttcgacgtcatgaaaaaaactgtactctttccatcgataatgcgttaaaatataaaagagcagggagccgacatatgaaaaaatggatgacagtttgcgcgctgtgtttcgtgttttttctgctggtatcctgccagcagaaggatgctgtcccggatactgcaaagaagctgaaagctcctttaacggggctaaagagtgaacagaaggtgactgaacgccggcctgttgctgttgtggtgaacaatcacccgaaggcgaggccacagtcgggtctgtctaaagccgacattgtcatagaagcgctagccgaagggcaaatcacaagatttctggccattttccaaagccagatgcctgaaactgtcggacctgtgcggagcgcgcgggaatatttcgtcactctcagcaatggctttgacagcatatttgtccatcacggctggagtcccggcgccaaaaagcagctggaatccggagctgccgattatatgaacggattagattttgacggaagcttattttggagagctgatttcagcaaaccgccccacaattcctatacgtcttatgattacataaaaaaggcggcagaacaaaagggttataagctgaagcaggaaacaaatccgctgctgtttcaaacatcagatgcaaaacctgcaaatgaatcttacaatgttcgggtagattatggaacaaataacgttacaaatcttgtcgaatacaactatgataaaaaagctgaatcttatacaagaagctctgatggtgtcataacgacagaccgggaaactggaaagctggttgcaatgcaaaatattttcattgttgaagccagccatcatattattgatcaagatggaaggcgggacatcgacttggaatcaggaggaaaaggtctgttgtttcagcacggaaacgtcattgaaacagactggaaacaagtgaatggcagaattgtgccggtaaaagacggcaagtggcttccgtttgtgccaggaaagacttggatcaatatcgtacctgatcttgatgcggcttccattagtaaaggagaaggtgtgtaacgatgcaaatcgataaattacgcggcaaagagctggaccagttatttaactcgatcttatcgctgaaagacctggaggaatgttaccgattcttcgatgatctatgcacaattaacgaaattcaatcgctggctcagcgccttgaagtggcgcgcatgcttcgcgaaggaaacacgtatcataagattgaaacagaaacaggcgcttccacggctacgatttcccgtgtgaaacgctgcttaaattacggaaatgacgcttatgaaatggcgcttgaccgtgtgaaggaaacggaaactgagtcttcttcaaaataacatagaaccgccctgccgttcggcaagggcggtttctttatgaaacaaattgatggatcaggttgtcgatatcgatgatactgccatcctctttccgatagacaacatgctccttggaaaagtgaatcggcgaattaatccctgctgcggctgcgaggttaaatagtccctcgcgcaatgaaataacgtagttgcagacacgatgctgtttttcctcaacgctcagtgctttttgcaatttcggatctgtcgtcgccacacctgccggacaggtgttggtgtggcagacgagagcgcggatgcagccaacggaaaacatcatgccgcgtgcgatgttgacaaagtcagcgccgagggctaaggcgaccgcgattttatcaggagtcaggagctttccggaagcaaagattttcagctggctgcgcaagccgtactgtttaagaagcgtgtcaacaataggcaacgctgtcataatcggaaggccgactgtatccgcgagctcgtaaaaggaagctccggtaccgccttcacttccgtcgatcgtgataaaatccggatgctttccgcttttctgcatatgagagaaaagctcatgcaattcttcaggatgccctgcgaccagtttgatgccgactggcttttgtccgacatctctaagtttttcaataaagtcgagcatttcaggagggtttgagaattcataaaagcggttcgggctgtcaatcgactttccaggttcgacattccgaatatctgccacttcctctgatactttggcgccgtccacatggccgccgcgggttttcgctccttgtgccagctttagctcaaacgctttaatttggccaatcctgctttttcttttaaattcctcccacgaaaattccccgtttcttttgcgcacgccgaataggcccggtccgatttggcaaatgatatcggcgccaccctttaagtgatactcagacaatcctccttcacctgtattcatccaggtgccgcctgcctgatggagcccttttgagagcgccgtaacagcccgttctccaagagaaccgtagctcatggcggactggccgactaagcccttcacataaaatggcttctcgcatgtatgctcgccaatcacctgtacatcatcaggatggagaaaatacgggtctgccttgatatgttcggcatgctccttgcgtttgaatagattgtcagcatccattttatagatttgggtttcaatttttggcgtttgatttacgtgcatttcttccctttgttttggaaacatagcgttacggatataatagccaggtttatcaaaatctcttacagatccaaagcccatcattctgcttttgtatttgccggagatgacggtttgctcatattcctttcgtgaaaaaggctgctcctcattgtcattgctgtataaatactgtctgagctccggcccgattttttcaaggatataccgaaaccttccgatgacgggatagttgcgaagaattgagtgctcctgctgtttttcatcctttatgtagatccaggcaaacaagacgatcgggatagcgatgatcccaatgataaatgcgatgagtgctattatgatggtttccatctctcagcctccctttttatgtaaccatttccacagttgaacactttccaaacaatagcagaaggaatttggtgaaaaatgtgtgctcctgccgatacaggactcaccatgcaggtactgccctatgctctctttttttatgaaaatagaatcaaaacacctttttcagtgaataacgagattaacggctttttccgtttttccgcgctatgtgaatttgttataatgtttaaatggtaacaaacgaatggaggaacgtatgacgtgtacgatgtaacagagtggaagcatgtctttaaactcgatccaaataaagatttgcctgacgaacagctggagattctttgcgaatcaggaacggatgcggtcattatcggaggcagtgatggtgtgacagaggataatgtcctgcggatgatgtctaaggtaagacggtttttggtgccgtgtgtccttgaggtatcagcgattgaagcgatcgttcccggctttgacttatattttattccgagtgtattaaacagcaaaaacgcggattggattgtcggaatgcaccagaaagccatgaaggaatacggagaactgatgtctatggaagaaatcgtggcggagggctactgcatcgcaaatccagattgcaaagccgcggcactgactgaagcggacgccgatctgaatatggatgatattgtcgcctatgcgcgtgtgtcggagctgctgcaactgccgattttttatttagaatacagcggcgtgcttggagacatagaagctgtcaagaaaacgaaggctgtattggaaacgtccaccttgttttacggcggcggcatcaaggatgcggaaacggccaagcagtacgcagagcatgcggacgtgatcgttgtaggcaatgctgtgtatgaagattttgacagggctttgaaaacagtagcggctgtgaaaggcgagtagtaaattgtacggatttggtttatgatagaacatatgttttgtataggcgggtgaacaaattttgaattatattagcaatcaattactaagcggtttaaaccccgttcagcaggaagcagtcaaaacaacggacgggccccttttgctgatggcgggagcgggaagcggaaagacgcgtgtcctgacacacagaattgcttatttaatggcagaaaagcatgtggcgccgtggaacattctggcgatcacatttacaaataaagcggcacgcgaaatgaaagaacgtgtagaaagcatccttggacccggcgcggacgatatctggatttccacattccacagtatgtgcgtgcggatcttgcgcagagatatcgaccggattgggatcaaccgaaatttctccattcttgatacggcggaccagctttcagtgatcaaggggattttgaaggagcgcaatcttgatccgaagaagtttgacccgagaagcatcctcggcacgatcagcagtgcaaaaaacgaattgaccgaaccggaggaattctctaaagctgctggcggctactacgatcaggtggtcagcgatgtatatgctgattatcagaagaagctattgaaaaaccagtcgctcgatttcgacgatttaattatgacgacgattaaactgtttgacagagtgcctgaagtgcttgaattttatcagcgcaaattccagtacatccacgttgatgagtatcaggatacgaacagggcgcaatacatgctcgttaagcagcttgccgagcgtttccagaacctttgcgttgtgggggattctgatcagtcaatctacagatggcgcggcgcggatatcaccaacattctttcatttgaaaaagattatccgaatgcaagcgtgattttgctagaacaaaactatcgttcaacgaaacggattttgcgcgcggctaacgaggtcattaaaaacaactctaaccgcaaaccgaaaaatttgtggacggaaaacgatgaaggcatcaagatttcctattatcgcggtgataatgagttcggtgaaggacagtttgtggccggcaaaattcatcagcttcacagcacaggcaagcggaagctgtcggatatcgccattttataccggacaaacgcgcagtcccgtgtgattgaggaaacgcttctcaaagcgggtttgaactataacattgtcggcggcacaaagttctatgacagaaaagaaattaaagacattcttgcgtacctgcgcctcgtatccaatccggatgacgatatcagtttcacgcgcattgtcaatgtgccgaagcgcggagtcggcgcgacatcacttgaaaaaatcgcttcgtatgcggccataaacggcttgtcctttttccaagcgattcagcaggttgattttatcggcgtcagtgccaaagcggcaaacgcgcttgacagctttagacagatgattgaaaacctgaccaatatgcaggattacttatccattacagagctgacagaagaaattcttgataagacggaatacagagaaatgctgaaggctgagaaatcgatcgaagcccaaagccgtttagaaaatatcgacgagttcctgtctgttacgaaaaactttgaacagaaaagtgaagacaagacactcgttgcgttcctgacagacttggcgttaatcgcagatattgatcagctcgatcagaaggaggaagagtcaggcggcaaggatgcgatcaccctgatgacactgcacgccgcgaaaggactggagttcccggttgttttcttgatggggcttgaagaaggcgtcttcccgcatagccgttcactcatggaggaagcggaaatggaagaagaacgccgccttgcgtacgttgggattacaagggctgaacaggagctttatctgaccaatgctaaaatgcgcaccttgtttggccggacaaatatgaacccggaatctcgcttcattgctgaaataccggatgatttattggaaaacctaaatgagaaaaaagaaacgagagcgacgtctgcgagaaaaatgcagccgagacgcggccctgtttcacgccccgtatcctacgccagcaaaacaggcggcgacaccttaaactgggcagtcggagataaggcgggccataaaaaatggggaacaggaactgtcgtcagcgtgaaaggcgaaggagaagggacggagctcgatattgccttcccgagccctgttggcgtgaaacgcctgttagcagcatttgctcctattgaaaagcagtaatcgaagaggaaaggaagaagcagatggacaaagaaacagcgaagcagcgggcagaagaactgcgccgcaccatcaacaagtatagctatgaatattacaccctagatgaaccgagcgtcccagatgccgaatacgacagattgatgcaggagctgattgcgatcgaggaggagcacccagacctcagaacgcctgactctcctacgcagcgcgtcggcggagccgtgcttgaagcgtttcagaaagtcacccacggcacaccgatgctcagtctgggcaacgcctttaatgctgatgatcttcgtgatttcgaccgccgtgtgcgccaagccgtcggtgacgatgtggcgtataatgtggagctgaaaatagacggtcttgctgtttctctccgttatgaagacggctattttgtcagaggagccacccgaggtgacggaacgacgggagaggatattacggagaatctgaagacgattcgcaatatccccctcaaaatgaaccgtgagctgtcgatcgaagtgcgcggcgaggcgtatatgccgaagcgttcgtttgaagcactcaatgaggaacggattaaaaatgaggaagagccgttcgccaatccgcgaaatgccgcggcgggatctctcaggcagctcgatccgaaaattgcagcgaaacgaaacctcgatatcttcgtctacagtatagcggagcttgacgagatgggtgtagagacgcaaagccaagggcttgattttctcgacgaactcggatttaaaacgaatcaggaacgaaaaaaatgcggcgacatagaagaagtcattacgctaatcgatgagcttcaggcgaagcgcgcggacctgccgtacgaaatagacggcattgtcattaaagtcgattccctcgatcagcaggaggagctcggttttacggcgaaaagcccgcgctgggccatcgcgtataagtttcctgctgaagaggtcgtgacgaagcttctcgatatcgaattaaatgtcggcagaacgggtgtgatcacgccgaccgcgattcttgagccggtaaaagttgccggcacaacggtctcaagagcatcccttcataacgaagatttaattaaagagaaggacattcggattttggataaggttgtcgtcaaaaaagcgggcgatatcatcccggaagttgtgaatgtcctcgttgaacagcgcacaggagaagaaaaggaattcagtatgccgacggaatgtcctgaatgcggcagtgagctcgtccggatcgaaggagaagtggcgcttcgctgcattaaccctgaatgtccggcgcaaatccgggaagggctgatccatttcgtttcccgcaatgccatgaacattgatgggctcggcgaacgagtgatcacacagctgtttgaggaaaaccttgtccgcaatgtggcagatttatataagctgacgaaggaacgagtcatccagctcgagcgcatgggcgaaaagtccactgaaaacctgatcagctccatccaaaaatcaaaagaaaattcgttagagcgcctgctgtttgggcttggcatccgttttatcggatcaaaggccgcaaaaacgcttgccatgcattttgaaagcttggagaacctgaaaaaagcctctaaagaggaacttctcgcggtagatgaagtcggtgaaaaaatggctgatgctgtgatcacctattttcataaagaagaaatgcttgaactcttgaatgaacttcaggagctgggcgtaaacacgctctacaaaggcccgaaaaaagtaaaagcagaggacagcgactcttactttgccggtaaaacaattgttctgacaggaaagctggaagagctgtcaagaaacgaagccaaagcgcaaatcgaagcgctgggcggaaagctgactggaagcgtcagcaaaaacacagacttagtcatcgccggagaagcggcgggaagcaagctgacaaaagcacaagagctgaacattgaagtgtggaatgaagaacagttaatgggagagctaaagaaataagaggagtgttttctattgaaaaagacgttggcattggcggcaacggcggcagtattaatgctgtctgcctgctcgtcaggttttggggggagaaggaggaagagattacgcaaaagacggcgaaatcgtcagaaaaagcgattgtcccgaaatataatatctctgactcctattacaaaatggtgctgccgtttaaggcaggcaaagcgcgcggcttaacaacggaacagctgaacactaggctggacattgacgagtttgaaacagggctgatgcgtcttgcccaagattctttctcgactgacgattatctgttccaagaaggacaatatttagatgaggatacagtattaagctggctggcacggaaaaaaacgggctctgatttgaaaaaagccgaaaaagaagataaaaacttcaaaaatgaaggcttgaacccagcgctcccgagctctggttcaacagaagaaaagaacgaaagcagcccgatttatttagcatccatgcttgagcacgattatttagtcagaaaagataagaattctatccagcttggcggcgtaatgatcggactggcgttaaactccgtgtattactatcgtgaaaaaactggagacccgcaaaaagaagtggagattaaggacagcacgctccgccagcagggagaaaaaattgcacaggaggttattaaccgcctccgtaaaaaagataacttgaagaatgtgccgattaccgtcgcactctacaagcaggcgtcaaaaacatcgattgtgccggggaacttcatcgccaaaacagaggtcaaagcaggctctactgatatctcaaattgggatgacattaatgaaaaatatgtattctatccggcggatacaaccacagcagaaaaatacccggatgacaccgaggtctttaagcggttcaaaaactcaattgaagaatatttcccgaactatacaggcgtagtcggtacagcgctgtatgaaaatgatgaaatgaagaaaatgaagattgacataccaatgcaattctacggaaaaagtgaagttgtcgcgtttacccagttcttaacgggtgaagtgatggactactactctaagagctcagttgatgtcgaagtcaatatcacgtcctcagacggacaggaagcggtcattatccgcaatgctggagataaagagccgactgttcacatttatgactgatagaaaacccttgtgccatattggccaagggtttttatgttacaattaacaggaaaagggaaatgattttcgcttctgccgaaacacaaatcaaggggaggtatgttgatgctggaaatcgtgtgaaaacaatcattatcaaatctatagcaatgaaaggatgttagacatgcataaagatatcaaaaaaatatttgaggaagagcaggttttggcagaagctgcagcgagatacggtttctcaaaagatcaggtgcgttttctggctgatgcggaaaactatgtatatgaatgtatgaaagacaatcaaccttatattttaaagattacccatacgattcggagatcttctgattatataatgggagagatggaatggctccgtcaccttgcaatagggggaatttcagtagccaaaccgctcccgtcgctgaacggaaaagacgtagaagcagtgccggacggaaacggcgggtcatttttattgagagtgtatgagaaagcgccggggcaaaaagtggatgaatcggactggaatgaaacgctattttatgagcttggcagatacacaggcagcatgcacagcctgacaaaaagctacaaattgagcaatcccgctttcaaaagacaggaatgggatgaagaggagcaattaaagctgagaaaatatgtgcctgaagatcagataaaggtgtttcagcaagccgattctttgatgaatgaactgcggaggctcccgaaaagccaggacagctacggcttggtgcatgcggatctgcaccatggcaattttaactgggatcatggcaaaatcacggcatttgattttgatgatatcggctacaactggtttgttaacgatattagcattcttctctacaatgtcctgtggtatcctgttgtgctatatgatgataaagctgcgtttacagaagaatttatgacgcattttatgaaagggtactgggaggaaaatgagcttgaccctgcatggctgatgataatacctgatttcctccgccttcgccatatgctgatttacggattgctgcatcagatgtttgaccttaacacaataggagaagaggaaaaagaaatgctggccggtttcagaagagatatagagaatggcacgccgattacagcatttgatttttcagcactggtgtagatagaaaaagccaatgggattccagtcccattggcttttataatgtatcacacttcacgccgactacgccttcaatggctttaatgtcatagtagacgtcggtcgtgtatctgtttttatggacgcggaccttcacttccataattggaaaatccttttcgcctaggtcgtcgatccgaacggagtgtgctttgatatctcttcttttcatttcttttaaaatctctgtcattttgtctttatcagaaagtgacattctgatgcggatgtctttttcctgcaggcggtcggggccgatttttctgaccacccatgggagaaactccacgctgatcaggatgaacagaagactggcaaacgcttctttataaaaaccggctcccgtagcaagcccgagccccgctgccccccagatcatggccgatgtcgtcaggccggaaatgacatcattgctttttcgcaggatgacacccgcgccgataaacccgacgccggagatgatttgtgccggcagacgaagcggatccatcatgatgcggtagtatttagggaaatgatatgccgcattaatactgacgatcgtcagcatgcatgagctgactgcgatgacaatacaggtttttaatccgagcggcttattttttaattcgcgttcaagcccgatgaccatgccaatcaatgtggcaatgcccaatttcaataaaatatcaggatcaatataccagctcaacagcaaacttcccccttctctatggtgtttttaaataaatatgattttctcacagtatttatcgcaaaacaagggcacaaaagccaccaagctgcgcttgatggcttattgcttactttttgcgttttaacagcttttccatgacaccgaataatcggtaagaggcttttgcaggacgttttgtgatcatgctgacaatgatgccggcaatcatactgagaataaacccagggatgatttcgtacacaccggttgattttgccaggccggttgtaatccagatcaacacggtcgcagccccgacaatcatggcagcaagcgcgccccattcgttcattcgcttccaatacagactgagcagaatcgcaggtccgaaagctgaaccgaagccggcccaagcgtatccgaccaaatcaagaatggtgctgttcgggttcaatgacaagagtaccgcgataacggcaatgactaagacggacaatcgcccgatcatgaccaattctttatcagaagcttttcgtctgaaaaatgaccggtataaatcctctgtaacagcacttgctgtgaccaagagctgtgaggaaatcgaactcatgatggcagccaaaatagctgacaataagaaccctgtaattaatgggtggaacaagattttagagaagataatgaaaatcatctccggatcttttacagcaactccgaatttatgggcgtatgcaacaccgattaaacccgtcagcacggaacctagaactgtaatgatcatccagctcatgccgattcggcgtgcaggcttcaaatctttaatgtttttgatcgccataaatcggacgatgatatgaggctggccgtagtagcccaagccccaggctaaataggaaataatgctaatgacgctcgcgcctttaaaaatatccaataagtgtgggttaacagcgccgatttcatggagagtcggagcaacgccgcccacatgggtaaaagcaacgatcggcacaagcactagtgctgcaaacatgatcgcaccctgcacgaagtcagtcagactgacagcaaggaaaccgccaaacagtgtgtataatactacaactgcggtggtcagaaacaagcctaatttgtaatccgcaccaaaagcagattcaaacagccgtccgccagataccataccggaagaggtatacaatgtgaaaaagatcatgatgatcaatgcagatacgattttcagcagtgatgaagaatgctggaatcgtttatcaaagaaatcaggaatcgtaatcgcatcatccgccgcttctgtataagcacgcagccttggagccagcagcaagtaatttgagtacgccccgattgtaagacctaaagcaagccataaggtggacagccctgtcgcaaacatcgcgccgggaacacccatcagcatccatccgctcatatcggccgcgccggcagacaaagcagtaacgaatggtccgaggcctcttcctccaagcatgtaatcattgatgtcagtggttttcttgaatgcataccagccgattaacagcatggcaataaagtaaattcctaaagatataataatttcaatactcacgttttaccctctcttcatttctaataatgttgcatcacctctcaaattgatggtgccagttaagcagcctggcgtaagtgcaaaacaaaagaaattcttttgcgggtgcacttggtaacttaacctaacaaagtattcccggccattcaagcgatgaaacattgatcataagctggaaataccgttgcaaacctagaagggaataaagaataaaacgctttcaaaaaataattaaagtaaaaatattcagaaaaatatttcgtttctccttctcctcattttagtataaaatatatagggtattgtttcgaaaacacaggcctgtctcaaggcgttttgttgctttaaagggcttgtttttgatatgatcagtattatatgacttaacggagaaatatgtggaggtggatcatatgtcacgaatttcaatagaagaagtaaagcacgttgcgcaccttgcaagacttgcgattactgaagaagaagcaaaaatgttcactgaacagctcgacagtatcatttcatttgctgaggagcttaatgaggttaacacagacaatgtggagcctacaactcacgtgctgaaaatgaaaaatgtcatgagagaagatgaagcgggtaaaggtcttccggttgaggatgtcatgaaaaatgcgcctgaccataaagacggctatattcgtgtgccatcaattctggactaaaggagggacacaagaatgtcattatttgatcataaaatcacagaattaaaacagctcatacataaaaaagagattaagatttctgatctggttgatgaatcttataaacgcatccaagcggttgatgataaggtacaagcctttttggcattagatgaagaaagagcacgggcatacgcgaaggagcttgatgaggcggttgacgggcgttctgagcacggtcttcttttcggtatgccgatcggcgtaaaagataatatcgtaacaaaagggctgcgcacaacatgctccagcaaaattctcgaaaactttgatccgatctatgacgctactgtcgttcagcgccttcaagacgctgaagcggtcacaatcggaaaactgaacatggacgaattcgccatggggtcatctaccgaaaactctgcttacaagctgacgaaaaacccttggaacctggatacagttcccggcggttcaagcggcggatctgcggctgcggttgctgcgggagaagttccgttttctcttggatctgacacaggcggctccatccgtcagccggcatccttctgcggcgttgtcggattaaaacctacatacggacgtgtatctcgttacggcctggtcgcatttgcgtcttcattagaccaaatcggaccgattacacgtacggttgaggataacgcgtttttacttcaagcgatttccggcgtagacaaaatggactccacgagtgcaaatgtggacgtgcctgattttctttcttcattaactggcgacatcaaaggactgaaaatcgccgttccgaaagaataccttggtgaaggtgtcggcaaagaagcgagagaatctgtcttggcagcgctgaaagtccttgaaggtctcggcgctacatgggaagaagtgtctcttccgcacagtaaatacgcgcttgcgacatattacctgctgtcatcttctgaagcgtcagcgaaccttgcacgctttgacggcatccgctacggctaccgcacagacaacgcggataacctgatcgacctttacaagcaaacgcgcgctgaaggttttggaaatgaagtcaaacgccgcatcatgcttggaacgtttgctttaagctcaggctactacgatgcgtactacaaaaaagcgcaaaaagtgcgtacgttgattaagaaggatttcgaagacgtatttgaaaaatatgatgttattgttggaccgactacaccgacacctgcgtttaaaatcggtgaaaacacgaaggatccgctcacaatgtacgcaaacgatatcttaacgattccggtcaaccttgccggcgtaccgggaatcagcgtgccatgcggattagcagacggacttccgctcggcctgcaaatcatcggaaaacactttgatgaaagcactgtataccgcgttgctcatgcatttgaacaagcgacagaccatcataaagcaaaacctgaactgtaaggggtgaaaagaattgaactttgaaacggtaatcggacttgaagtccacgttgagttaaaaacaaaatcaaaaattttctcaagctctccaacgccattcggcgcggaggcgaatacgcagacaagcgtcattgacctcggatacccgggcgtcctgcctgtcctgaacaaagaagccgttgaattcgcaatgaaagccgctatggcgctcaactgtgagatcgcaacggatacgaagtttgaccgcaaaaactatttctatcctgacaacccgaaagcgtatcagatttctcaatttgataagccaatcggcgaaaacggctggatcgaaattgaagtcggcggcaaaacaaaacgcatcggcatcacgcgccttcaccttgaagaggatgccggaaagctgacgcatacaggcgacggctattctcttgttgacttcaaccgtcaaggaacgccgcttgttgagatcgtatcagagccggacatccgcacgccggaagaagcgtacgcgtatcttgaaaagctgaaatccatcatccaatatacaggcgtttctgactgtaaaatggaagaaggctcacttcgctgtgacgccaatatctctcttcgtccgatcggccaagaggaattcggcacaaaaacagaattgaaaaacttgaactcctttgcgtttgttcaaaaaggccttgagcatgaagaaaaacgccaggagcaggttcttctttcgggcggcgtcatccagcaagaaactcgccgttatgatgaagcaacgaagaaaaccattcttatgcgtgtcaaagagggatctgacgactaccgttacttcccagagccagatctagtcgagctctacattgatgatgaatggaaggaacgcgtaaaagcaagcattcctgagcttccggatgagcgccgcaagcgttatatcgaagagcttggcttgcctgcatatgacgcgatggttctgacgctgacaaaagaaatggctgatttcttcgaagaaaccgttcaaaaaggcgctgaagccaaacaagcgtctaactggctgatgggtgaagtgtcagcttacctaaacgcagaacaaaaagagcttgccgatgttgccctgacacctgaaggccttgccggcatgatcaaattgattgaaaaaggcaccatttcttctaagatcgcgaagaaagtgtttaaagaattgattgaaaaaggcggcgacgctgagaagattgtgaaagagaaaggccttgttcagatttctgacgaaggcgtgcttctgaagcttgtcactgaggcgcttgacaacaatcctcaatcaatcgaagactttaaaaacggaaaagaccgcgcgatcggcttcctagtcggacagattatgaaagcgtccaaaggacaagccaacccgccgatggtcaacaaaattctgcttgaagaaattaaaaaacgctaataaaaaagcagcccttagaggctgctttttttatggtcaaattgagataaagacagagatgagggcccgaagcctttcaacttctttgtcgttggttccggtcaaattggacagcatgcctttaataatcggtttgcgcggtttatcctgagtcaattcttcctcgataacatcaagtgacacggtgatatcctcgggcagcgtgctgttttctttcgctttctgaatgtcctcaagcagctggtctttccccgcaggcatcgggttgaaaatgtcttttggcacaatcggattgagtgctgaacggctcagcccctgtacaagatcatccagtctctcgatgataaaggctgatatttcttctgcaccgatattaagctcactgttaaataccatcacattcatataggaatgcacgatgcctcttgccatgatggacagatctgcgacgtacggctcgattccttttccataggacgacagcaaggcgttccggtacagcttatccgtctccatggttactttgtaaaagtattgcttgatttcttgattttccggaatgatattttcggtaagcaaaagtacgataaaatctttatgatcacgaaaatcctcaaattgagcgccaatttgttttttcaaaacttctttaggcggctttccagcgagatcttcttctatatttttcattttgttcatagacataccgatataatattcacaggcagataacagcagcgcttctttcgatttgaagtgcaaataaaaagcgcccttcgaaatgccgcattcactggcgatttcttggatcgtcgtagctgcgaatccttttttcgcaaataaacgaatgctggtttttatgattttctctttttttcattcatgacgtgcttccccttaatccttgaaaaatttagtaaaattttctggtatatgagttgacgttgttgcgttataacgtttagtattatatagaatgaccagtcagtcaataaaaaatgtaatggaggatatgatgaaccacgttattaatttcgttctgaaaaacaaattcgccgtatggctgatgacgattattgtaacggtagccggcttgtatgcgggtatgaatatgaagcaagagtctattcctgacgtgaatatgccttacttgacgatcagcacgacatatccgggtgcgacaccaagccaagtggctgatgaagtgaccaaaccggttgaacaagccgtgcagaacttggacggtgtcagcgttgtgacgtcgacgtcctatgaaaacgcatcgtcggtcatgattgaatatgattatgagaaagatatggacaaagcgaaaacagaagcagctgaagcgttagaaaacgtcagcctgcctgatgacgcgaaggatccggagatttcacgctacagcttgaactcattcccgattctgacgctgagtgtgtccagtgataaagataacctgcaagagctgacgaaaaaagtggaggacagcctcgtttctaagcttgaaggcatagaaggagttgcatccgtccaagtatcgggccagcaggtggaagaggttgaattctctttcaaagaagacaaactgaaggaatacggccttgatgaagatactgtgaagaaagtgattcaaggttcagatgtgacaactccgcttggattgtacacattcggaaatgaagaaaaatctgtcgtcgtcagcggcgatattgaaacaattaaagatttgaagaatatgagaatcccgacggcatcagcttcaagtgcaggcagcagttcagcatctcaagcggcggcgcagagtgcacaggcagcccaaagcgcacaagcggcagcacaggcgcagcaaagcgcaagcacagcagtgccgacggtcaagctttctgacattgccacaattaaagatgtgaaaaaagctgaatctgtttcacgcacaaatggcaaagacagcatcggcatcaatatcgtcaaagcaaacgatgcgaatacggtagaggttgccgacaatgtcaaagctgagctgaagaagttcaaagaagaccataaaggcttcaattacagcgcaactctcgacatggcggagccgatcacacagtcagttgacacgatgttaagcaaagccatcttcggtgctatttttgcgattgtgattattctcttattcttaagagatatcaaatcaacattaatttcggtagtttcaattccattatcattgctgatcgcactccttgtgctgcagcagcttgatatcacattgaatattatgacgctcggcgcaatgaccgttgccatcggacgtgtagtcgatgactccatcgttgtcatcgagaacatttatcgccgaatgagactcaaagacgagccgctccgcggaaaagccttggttcgtgaagcgacgaaggaaatgtttaaaccgatcatgtcatcaacgattgtgacaattgcggtattcctgccgctcgcacttgtaggcggacaaatcggtgagttgtttattccgtttgccttaacgattgtttttgcgcttgccgcatccctggtgatttcaatcacgcttgtgccgatgctcgcacacagcctgttcaaaaaatcattaaccggtgcgcctattaaagcgaaagaacacaaacctggcagacttgcaaacatctataaaaaagtattgaactgggcgctgagccacaaatggatcacgtctatcatcgctgttctgatgctccttggaagcttgttccttgtaccgttaatcggtgccagctacctgccgtccgaggaagaaaaaacgatgcagctcacatacagcccagaaccgggtgaaacgaaaaaagaagccgaaaatgaagctgaaaaagcggaaaaaatcctgcttgaccgcaagcatgtcgatacggttcagtattcattaggctctggcagcccgcttgccggaggagattctaacggtgcgttattctatatcaaatatgaaagcgacacacctgactttgataaagaaaaagataacgttctgaaggaaatccaaaagcaatctgaccgcggagaatggaagtcacaggacttcagctcttcaggcaataacaaccaattaacatactatgtgtatggcgattctgaaaacgatattaaagacacggttaaagacattgaaaaaatcatgaaagatgaaaaggatctgaaaaacgtaaattcaggcctttccagcacatatgatgagtacacatttgtcgctgaccaagaaaaactaagcaaactcggtttaaccgcgtctcaaatttcccaggccttaatgtcacaaacatcgcaagaaccgctcaccaccgtgaaaaaagacggcaaagagcttgatgtgaacattaagacagaaaaagacgagtataagagtgtgaaagatttagagaataaaaagatcacttccgcgactggccaggaagtcaaaatcggcgatgtggcaaaagtgaaagaaggatcaacatcagataccgtgtcaaaacgtgacggaaaagtctatgcagatgtcacaggtgaggttacctctgacaacgtcacagccgtatcagctgctatccagaagaaaatcgataagcttgaccatcctgataatgtatcgattgacacaggcggcgtatcagcggatatcgctgattccttcacgaagctcggtttagcgatgctggcagcaatagcgatcgtttaccttgtgctcgtgattaccttcggcggagcactagcgccatttgcgattctgttctcattgccgttcacagtcatcggtgccctggtcggactttacgtatcaggtgaaacgatcagtctgaacgcaatgatcggtatgctcatgctgatcggtatcgttgtcacgaatgccattgtcttaattgatcgcgtgattcataaggaagcggaaggcctgtctacgagagaagcgctcctggaagccggctctacacgactccgtccgatcctgatgacagccattgcgacaatcggcgccttgattccattagccctcggcttcgaaggcggaagccaggtcatttcaaaaggactcggcgtaacggttatcggcggtttaatcagttcaacacttctgacactcttgatcgtgccaatcgtatatgaagtattggcgaagttccgcaagaaaaaacctggaacggaagaagagtaaaaaaacaaaaagcctcagctctgctgaggcttttgtgcgttttcacctgtaagattatgtacattttgttgcgatttttttaactcatagtataattaaaggttgttagtgtaaaaatggatcggatactcttaagtaggatgatgagataatgaaacgtgcacgcataatatacaatccgacttcaggacgggagatctttaaaaagcatcttgcccaggtcctgcaaaaatttgaacaagccggctatgaaacctccacccatgcgacgacatgcgcaggagacgctacacacgctgccaaggaagcggcattgcgtgagtttgacctgatcattgcggcaggcggagacggaacgatcaacgaggtcgtcaacgggcttgcgcctttagacaatcgtccgacactcggtgtgattcctgtcggcacaacgaacgacttcgccagagcgctcggaatcccacgcgaggatattttaaaagcggcagatacggtcattaacggcgtcgcccgcccgattgatatcggacaggtcaacggccagtattttatcaatatcgccggaggaggccgtctgacagagctgacgtacgacgtgccaagcaaactcaaaacaatgctaggccagcttgcttattatttgaaaggaatggaaatgctgccttcacttcgtccgacagaagtcgagattgaatatgacggcaagctgtttcaaggtgaaatcatgctgtttttggtcacgctgacaaactccgtcggcgggttcgaaaaactcgcgccggattccagcctgaatgacggcatgtttgatttgatgatactaaagaaagcaaaccttgctgaatttatcagggtcgctacgatggcgcttcgcggcgaacacatcaacgaccagcacattatttatacaaaagcgaaccgcgtgaaagtcaatgtatcagaaaagatgcagctgaacctggacggcgagtacggcggcatgctgccgggcgaattcgtgaatctgtatcgacacattcacgtcgtcatgccgaaggagaaagcggaacagctggatgactaaaacttggctttgtaagccaagtttttctttcgcttaaaacaagaggtgaacatacatgaaaatgaaacccccagtagaaaaaaacgaatactatgacgtgacatttgaggatttgacccacgaaggagcgggtgtcgcaaaggtccaaggctttccgatcttcgtgccgaacgccctgccggaggaaaaagcccaaatcaaagtgacacgcgtcaaaaaagggttcgccttcggccgtctgattgagctgaaggaagaaagcccgcatagaacggacgccccatgcccaatttacaagcaatgcggcggttgccagcttcagcacatgacctacgaaggacagctcttgtttaaacaaaaacaagtcaaagacgtcttggaacggatcggcaagctggacctgtccaacgtcaccgtgcacccgacactcggcatgcaagacccatggaactacagaaacaaagcacaggtgccggtaggagaacgggaaggcggactcgtcgccggattctatcagcaaagaagccatgacatcatcgacatgagcgcctgcctgatccagcaatccaaaaacgacgaagccgtccaagccgtcaaagacatttgtgccacatacggtgtcaaagcctacaacgaagaacgccacaaaggctggctccgccacatcatggtcagatacggcgtcgtgacgggcgaaatgatgatcgtcttcatcacaagaacgaacgacttcccgcacaaagcgaagatcatcgaagacatcacagcagcgttcccgcacgtcaaatcaattgtgcaaaacatcaacccaaacaaaacaaacgtcatcttcggaaatgaaacaaacgtcatctggggtgaagaatacatctacgacctcatcggagacgtcaaattcgccatctccgccagatcgttttatcaggttaacccggagcaaacaaaagtgctctacgacaaagcgctggagtacgcggagcttcaagggaagaaaccgtcatcgacgcctactgcggcatcggcacgatttctctcttcctggcgaagcaggcgaaaaaagtgtacggtgtagagattgtgccggaagcgattgaggatgcgaaacgaaacgcagcattaaacggcatcacaaacgctgagttcgcggtcggtgaagcggaaaccgtgattccaaaatggtatgaagaaggcatcacggctgatacgctagtcgtcgacccgccaagaaaaggctgcgacgaagccctcctgcggacgattgtggagatgaagcctaagcgggtggtgtatgtgtcctgtaatcctggcacgcttgcgagagacctgcgggtgcttgaggatggcgggtatgcgacgcgcgaagtgcagcctgtggatatgtttccgcatacgaatcatgtggagtgtgtatcaaagttagttttaaaaaatgattgagggaattataacccctcaacctgtacaaatttatagtagatcttaacatctttgtttgctattgctgagtttatcaataaaatgtaaatggcatttggatgctaacttattgaactgtaaaaacttttaagttgttctatgatggcagaaatttcacttgtttcgtaactttctgccatcctcttttttatcgctactttataatcaggtttagatatctcctcgttaatgaactttttactgcgtcctccttaaattaaatttgttcctgaaccagcttttcagtgaacttaaactttcttgaataacccctgatgagccaccgatttttaacagctccccgatcttagcaagtacatagcctatcctttcaaagttatgttcattaataatagatgtagaagttaagtttaaaaaatgaggtgcagagagaacgagggctgcggttattaattagaacataatactattttatccatagaacaaacaataggaactaatggttaattcgttctgcaacactataactatttatgtcagattatacagatttttgtggtatgatgaatttaggaattatattacttttgtaagggagttaacaaatgcttttttctgaactgtatagtgtaataaagagtcaagatgaaatatggtttgatcctattttagatgtggacactaaattatttattgatccttttctgctatttagttcttcagaagaacactttaaaaatgcacattctaaagtaattcatttttttaatgaggcatttatattggcggcaaagagtagtggagtgccttcaagcttatattacaaaaaattaatatcaatgcttacttttccagaggttgaggaaatttgtctaggttataccaataaaagtactgggggttcaggtggtggtgagggtttttctcactctatagctgcagcactaataaaatctattagagttggaattaaagagattaatcattttgaagaaattgggatactcgagaaaggtattggacgtgatagaataagcgatatttgtgcaaatattattaaagaagaattgattgcgtttactcaagatatttgcgctaaacatgtcataccacttaagcaatttagggttaaaattcaagatttaattttgaatttaagagatgggaacataatattgtttctcttcctttaaatccaactaataacaaacccattttattagtacctgaaagtattttaagagagcttcctagtattaacgcagatgggttccttgattgggcttggtcgaatgaaaatgaaaccttgagaactgattttaattttgaaatcaaaagtaaaataaataaagaagacattattaaggttgcttcaaatagggttgactttttggaaaggtatgtgaattatgtagaaagtaaagtttcattaccctacgatatagataaggatccaagtggaatttataaatggtatgaacaatctcaaaaaattcaacaaatgaaacctatagaactgccaattcctaacgatcatgttgaattagctgccttagttaaattacttatcgaaagcttcaattcgtttataattaacaattcaggttataaactattgtggaatgaaacacctctaacaccaaaaagagaagaagcttctcaattattattctttggattagttaaggaacactgtaaggcgaataatattgatttttctagggaagtcaatcaaggaagaggccctgtagacttcaaattttcaaatggacaccaagatagagtattaattgaggtaaaaagggcaagtagttctaaattaaaacaaggtttgctaaatcaattaccccagtatctagatagtgaagatattcaaattggctactatgttgtaattgtacaaaaagaagaagagtacaaaaaaattagtggtcttaaaggagaagcaaagaaattaagtgaagagttaggtaaatttatagatgtttttgttattgacgcaatttatgataagccttcagcttctaacattaaataaatacaactacattttgacatataacttatataaagaagtcttaaaagcatttaagacttctttatacgtattgaaaagctaattcattagctatactgttcaattagactttaatatagaagaaaaaatggtaagatattatcggtagtaagggtgtgttaatatgtgggaaaatccatggtttgttggtattggaggtggaataataagtggtttatttgtattttttatgactaattttatttttaataaaataagtaaaaaagactacttaaaaaaagtacatcaaagtaataaggaaatgataagcttattaatactctccatttcagaaggagagcttccctccttaaagatactcaattcattattatcgtcattatctagaaaatataatgttaaactacaagatatgaatagtataaaggaaaatcttgaggatcttataagagaagtttttgatactaactttatagctattgataaaaaaattagtatatcagagagtctagagaagatgataataaaaattgaaagagaagattttaaaaagaaagaagaaaagaaagtgggacgaaatacatacataaatactaataaattatctttatttgtaccaacatcagttatggcaatgacagtaactattggtttaagtttcgctctaatttacacaaaggataatcaagttaatttattatttgataacgatatttcctttatcacgttgttattgggagttacattaacaattgtagttacactcatgtcatttatatcaactaaaataagcaaagaaaaacagttaaaattaaatgaaatgtataaaaaaactctattatttaaaaaaagaccaggtataaccgataaagaagattgttgaatagaagaataattctctgtttataggggcttataatagtaatttataagattttaaaaagtagagaacgatccctataaaaaaggaactatattaatttcaattattcaacactgggtaggggagaatgttagtagtatggaaggaaatatttaaagagaagtattatttacagcttttcgttttcagtagtttaagtcttattagaataactaaattggttattatgttattctctttgctttaggaatgggatcgatgtatttaaaacaattttaagactgtagttactgttctaaaaaagtttttgcagactcctcatttagaatagatccctaagtgttcataaacccaaatttgtttccgttgagagattgtgtattgagaatgtaaaacatcctcgtaatcgtattctattgataacttttcgtttatctctggctgaagtgtcaagttcgtccagacatcttggttattttctttgaactcatcttgtaattcctcaaatgagtcaagtaattgtaataataaatcatcataaatgtcctcactaacatgaaaatgttcatggatattatgagaatagatataatcctcactttgcggaggattgaaataaaagaaaacctcagaagaatcgtcgagtatttctgcataaagaatgactttttcccatttggaaggaatgatttcgttaatgcttctgctatctgttgatataattcacccatttttctgtttccatgctaacctccagttttcaagaactatttcaaatttagatttaggtagctaattaaaaattctttatcatcctcgtctttaggcaaaataccaagagttttgtactcccataatgcaattctttgatacccatctaactcagttgccaaaatatcgtcatcattataatctagttgtaattgaccattgctctccaatgtcaatgtaaggttagtccaaacctgatcaatattatttttgtgctcaactcttaattcctcaaaaagttctcggatttctcttaataaagttttgaagacatctttacttacgttgtattgggcaggtatatcttgtgaataaataagttgatgtttttctggtgtcttgaagtgaaagagaaccatgatagagtcatttaatacttctgtataaagataaatttttgtccattcacaaggtatgatgtcatttaatttctgactaataagctgatacaaatcttgcatttttttagtttccaatcttttcaccttcaatcgttgagaaatcttagttatcaaaaatagcccagcagagaagggctgagccattttttgatttatagaccgaagtagtttattacaaattctttatcgtcctcatctttaggcaatatccctaaattttgatatttccaaacatctcgtctttgaaggtcatcaagttcagacgataaaacatcatcataattataatcaattgaaatctttccggtgttttctaattttaaagtgagatttgtccaaatatcttggttgcctagtttaaattcttcttttagttcttcaaatatctcttgaagttcaattagcagttgatcgtaactctcttcgcttacattaaattgttcaggtatattatgagaatataaaaataatcactattatttgatgttgtaaaataaaagtatatatctgctgagtcatcaagtatttcagcatataaaactatcttttcccattgagatgggtcatttcatttagatattcagcaatcttttgatatagttcacctatttttacagtttccattaaattaacctttaactttgaattgttgatggcattatttaatatttaaataatccttaacaaattctttatcctcttcgtcttcagggaaaatacccaagttattgtactcccaaatcatttgtctttggtattcgtccaaagtagattcaataacatcttcataatcataatcaattgagaacgttccattgctttcaagattcagtgtcaaatttgtccatgcttcaggattattttctttaaactcattgtgtaactgtttaaataactcttgaagatctattaatagttcggtataaatctttttactgacttgaaattgttctggaatgtcgtgagagtatatatattcatcgttttctggtgtttgaaagaaaaaatacacttctctggagccgtctagtatttcggcataaagaacaattttactccaatcagcaggaattatttttcctatgacatcagttatttgtagataagtgctttctaacatcattaacccaactttattaaattggattttcaggatattcttctaaatattttttaattaatttttgtaatgatggatccttaggttcttcccctaaatatttaaatttccagatgatgagctgatcactgaaactataatcagtcttaaaccaatctgtataatcaaagttgacagttaattttcctgatctctctaggctaagagtgaaggaataaaataattcttgatcatgatttttgaaaacatctctcattttttcgcttagtttaaataattccatctcatactgatcgaattcattttcgtcaatatcaaattgaaacggaatttcaagactgtacttaaaatgattaggttcattttgagaattataaaaaaagtaagtgcctccgcctgtctctgaaacctgagcatagaacaaaaatttctcccatggttctggtatcatttcgttaacggtttcagcgatgcttctatataatgcatttaattcattttccaacaagaatcaacctccagcttgattttttataaatttcttaaataatcctttgccttcaattctgtaaataacctcaaaagagtctggtcttagagagtctcctaaatatttcggtcgaattcttactgagactttcctcggtggttcctcttttagagccgccgcccattcggtctccattttgtaccattctccgccagaacggttaatttggctattttgagcaactaagttatctagttctccagaacctctgaattgtgatcctatcaaatgcccgccatcgtcatcaggtaatcgatcttgaggcttaccagcgtttgattgcgcatattgatttcgttttgcttctcctaattgtaaatcagcttcaacttttgtaattctaccatagttgtctgtattgtatgtgtagccctcttttgttttatattcgacattcggtttcaatactttctttctgctccatttcgcataatgttcgccgtatttgacggttaccggcggtacatgtggcgctggagttcttcttccgcttgatgacgttccgtatggtttcggaaggatgaccttggcgaatttttgcagtccctctttaagtgtgaccccgttgactgcgttgtaaggaacgcctgccggcactaaatcgtgacggggatgataggggagaatatccgcaagtgtgagatctccgatttgatttaacttggttttgacgtgttttttgatacttctatgcctttgtttactttttgtttgacgtgatcaacggtttgttttgagaccgttatggctttttgggctgttgctgatttgcttgctgctgttttgactttggtcgtcactttggcagctgtgcctgttttagagacggcgccaacaccttttgtgccgacaattgatgtgacaaccgtgccaaccgcatatgacacccatcttgctcttgagtaggtgtcgccattcaccatgtctttttgatacgattcttcgattgctgctgaaatggcttcatacgttttgatcgggtgagccacagctcctgtaatcgcttcaacagttccgcccggatctgtgaccatatcccataggcctactaccgcgtcttttccggaatcataaaggccgacggcaacccctttgaagcctgcttcaagctcacgcgtgttttcaatttgggtgaagtatctctgctgttctgctgtcagattttcatagccaatcgtctttgccattgagtagaattcatcggcatccgcataatcatagtttttcagtctttctttcagcttttcaatctcgcgttccttcgcttcctctttcttaatcttcaagtaagcctcagtccgcttttcaatgtcgccctttttcttatgtatgtcactctcacggtacgccttggcgttgtagtggatgggtgtggcgtttttgcctttgcccgttgcttcttggagcttttggaagtcggatttgatgaattgttcgtttggttctgacagggcgtattcagtctgcaggtcttcgtccaaggcgtccaatttttccagtgtttttttgcgtttatcgttggcatcggccagctcgtctttgaaggtttctgttgaaaacaggtcgagcgggaggatgtcgtcgatatcgttcaggatgtctttcatcgcttttttctgttcggacatgatggattttgattttttatgggcatttgccagttcgtgctccaggaaggactcttcgatgtatgcgtctgagaggcctttgtcttcggcggctccggcgatgctgttgaaaaatgcgattttcatgtcgatgtagtcgatccattggtcggtgacgccgacgtggtcgtgatagaaggctttgatgttgctggcgccttttcctgaaaattcgctgtcactgagatcagcgacactttttaacgcttttctcaagttgaccatttgcgttcttagttctttgtactcttttgcacggtctgtcgcttccgaaagcagtgttttcgcttcaaatactttcatgaccatttcccttcttttgttcactcaatatcaaaattttaccacggggcgggatgagggtgggggtgagaacgtgttttggtggaaaaatgagtcatttggcatgtgtctaagtgcatggttttgataagatgatgatagatcaataaaaaggggaagagctcatttggataaagacttcttaatcataaagatcaaggatattcaaaaaggtgacacgctaacgaaccgcgcttgcgggaactgggatatgaaattgtccagagcaaaggaatgtaaacgggcaattgttgttcggagcggtgtgattttaaatgtttacaagatcgttgacgcttgggaatctgatgaaccagccaaaatcactaaaacgaacaatagagtccggtttcaattggcagagtgccgagactattcttatttgattggcggtacgctgaaaacaaaaacgcaaaatccggtttcgagtctatccttagaaaccttaatggaactagtaaaataaaaggggtccagcatgtatctctataaagtaaacaatcaaaatcaaatcgaagatattcgcgagaaaccgtttaaaaaagaaaaagagattcaggatttatgtgaagccaatcttcagcaaatgttggggctagggtttgtgaaatctgaattcagaatcagtaatttccgcattgatacgttagcgtttgatgctgagacgaaatcttttgtgattatcgagtataaaaatacgaaaaacttcagtgttgttgatcagggctacgcctacttagcggcaatgctcaatcataaagcagatttcattcttgagtacaatgaaaatcatgatcttccgttaaagcgggatgatgtagactggtcgcagtcgaaggtcatttttatctcacctgtatttacagtgtatcaaaagcaatcgatccattttaaagatctgccaattgaattgtgggagattaaaaggtacgaaaatgatctgatccagttgaatcaaatgaaggctgatggcgtctccgagtcgattaagaccatttcgcagcaaagtgagaccattcaagaggtcagcaaagaaattaaagtgttttctgaagaggatcatcttgcagataaaccgtttgacatcatagagctttatcagcagctaaaggaattcatttttaatttggacgatcatatttcaatcaaaccgacaaagctttatattgcgtttacatcaaataagcgaaatttcactgacattcttcttttaaaaagcggacttaagctgtgggtgaatatgaaaaagggagaattgcatgatcccgaggacagaatgcgcgatgtctctgagaccggccactggggaaatggcgactatgagattttcataaaagatgatgaacacattgaatatatcatgggattgatcaaacaatcctatgagaaaaataagtgagaacttccattgagaagttcttttttattgtggcatgctaaagaagaattcatttcagtccctttcagtgtctgtaaaaatgaaatgtacaaaccgacaaaagacctataaaatgagaaagctaccatgagagaacagaagggtgagaagagacaatgagttataaattgggtgcgctgcttttatctattttattcctattatcggcgtgttctgatagcggagcttctgataaggatcaagaaaagcaagccgtgaagaaggcgagcgttgcgaagctgacggagcaggaagtaaaatcagctttgaaaaacgatattgattcgatctttaatgcatttgataaagcgggaaaagaaaacggctggagcacggcaaacaaggcggatttcaacaagctacggcctagtgtgctgccttatgcaacagaaacgtttgcagatcagaccttaaaggatttggccggagagtacttttgcgagtgtgatgctccttttcaccccggcactgatttcgatgtgcgttttacttatgaacagaacaagaataagatagaggcttcatcaatagacccggcaacagagttaaacaatatgggcacgttatggacgtttgaattggtgaaggaagatggcgattggaagatcaacaaatgggacagtaagtcgcttcaaggggatgatatcaagctgacaaaagaagaagcgaaaacgattctgtctagaaacggtgaaacggcggaatttgtgaagtcctatgaatcgaaggctgctggcggaacagcttatcttttcaatgtgaaaagttcaaatggggaaagaaaggcagcgatcagctcaaaggataccagtctggtaagtgataatgaaaacgagactgaggccccggagcaagagacagctcagaagactgcggaaaccgcatcgcccgatacagcggatacacagagcagtgagcagacaacgggaagcacaaaagcagattatgttgccaaattgtcagcgacagaacagaaagaaaagcacaatgactatcaaagtgattatcagatgattgaggattacggttacaactatcaaatgtgggacggattgctgaacgagatatacggcgtgctgcaaaaacagcttcctgcttcagacatggcggcattaaaagtgaaacagcgccaatgggtgaaggatagggatgctgcggcccagaaacgatatgatgaggagggcggcggttcattatcccgagtcgtccaaacagaagagcttgccaaacagacgaaagagcgctgttacgagctggtgaatacgtatttgaaataagattgacatgggacccttgcataaagggttcttttttatgaaaaaaacaaattgacaggatgaaaaagcaatttcttccttctgtattgttttcaaaatttgggattgatagaatatgacatatctcatagagaaggagggaagccgttgagtcaagccataccgtcttcgcgtgttggtgttaagattaatgaatggtataaaatgattcgccagttcagtgttccggatgctgaggttctgaaagcggaggtggagcaggacattcagcagatggaagaagaccaggatttgctgatctattattctctgatgtgttttcgtcaccagctgatgcttgattatttggagccgggacaaacatacgggaatcgccctacagtgacagagcttcttgaaacgattgagacccctcagaaaaaactcacaggccttttgaaatattactctttgtttttccgcggcatgtatgaatttgatcaaaaagaatatgttgaagccatcgggtattatcgcgaggcggagaaagaactgccgtttgtgtcagatgaaattgagaaagcggaattccattttaaagtggccgaagcgtattatcacatgaagcaaacccatgtgtcgatgcatcatattcttcaagccttagacatttatcaaaacaatcccctatacagcattagaacgatacaaagcttgtttgtgatcgccggcaattatgatgatttcaaacattatgataaagcgctcccgcatttagagacggcgctcaaattggcaacggacattcaaaacgatcggtttatcgccatttctctattgaacattgcaaacagctatgacagatcaggagacgatcagatggctgtagaacatttccaaaaagcggcgaaagtaagcagagagaaagtgcctgatctgcttccgaaagtcttgtttggattaagctggacattatgtaaagcgggccaaacacagaaggcgtttcagttcatagaggaaggattagaccatatcacagcacgttctcacaaattttataaagaattgtttctgttcttgcaggccgtgtacaaggagactgttgacgaacgaaaaattcatgatcttttaagctatttcgaaaaaaagaacctgcacgcttacattgaagcatgtgcccggagtgctgccgctgtttttgaaagcagctgtcactttgaacaagccgctgcgttttatcggaaagtgctgaaagcccaagaagatattctaaaaggagagtgtttatatgcctattaagaaaaaagtgatgatgtgcctggctgttactctagttttcggaagcatgtcgtttccattcctgacaaactccggcggatttaaggaaacaacagatcgaaatacgacgtatatcgatcattccccttacaaacttagtgatcagaagaaagcccttagctagggctttttcttgctttacggaagacgttccattttccacagcggcattccttctatttctaacgcaagacactcgaaacaaccaaaccatttgaggtataatggataaagtgaataacagtatttagattgatatatatgaaagagagtggaacatcatgggccgtaagtggaacaatattaaagagaagaaggcgtctaaggacgcaaatacgagtcgaatttatgcgaagtttggccgtgagatttatgtggcggcgaaacagggcgagcctgatccggaatccaaccaggcgctgaaggttgtgcttgagcgtgcgaagacttacagcgtgccgaaaaacatcattgaacgtgcgatcgagaaggcgaagggcggagcggaagagaattacgatgagcttcgttatgagggcttcgggccgaacggatcaatgattatcgttgatgcgctgacgaataatgtaaaccgtacggcgccggaagtgcgtgcggcgttcgggaaaaacggcggaaacatgggtgtgagcggatctgttgcttacatgtttgacgcgacggctgtaatcggtgtggaaggcaaaactgctgacgaagcgcttgaaatcctgatggaagcggatgttgatgtacgtgacattttagaagaggatgacagcgtgatcgtatatgctgagcctgatcaattccatgcggtgcaagaggcgtttaaaaacgcgggtgtcgaggaatttacagtagcggagctgacaatgcttgcgcaaagtgaagtaacgcttccggatgatgcaaaggaacagtttgaaaaattgattgatgcattagaagatttggaagatgttcaacaggtatatcataacgttgatttaggtgagtaaggagtgagcaggctgttatggcctgctttttttgtcctggaaattgttttagctgtctgtaggcggccgcctatacgatctataagatattctcatactctggactgtaacctatgtgaaggagagagtgaatatgactgatacaagacatatgtatggcggacctggttttggtcattatcagggctttggtattggccacccgggttatggcatgtatggaggccacccgggctttggcatgtatggaggctacccagatcacggcatacatggaggtgttggcggctatccgggatatggaacgtacggaggatacggaggatccggcggttacccaagcggcggctatggaggctctccgggaactgtaaattatccgaacatgcaccatgaaaatgatggccatcaccactattatcaccatcatcatgatggaaaagataatcttcatcaccatcatcaccatgttggaaaggataattatcaccaccatcatgatggtcattatggccaccatcaccaccatatgggccactggggaaaagacggttataaataaagaagatgatggtataaagaggacactcttgcagatcaagagtgttttttatcttttttcttgactgttcagtctggaaactggtaacatttgtttcaggaggtgatcgttttttggggaggaataaagaatttgatacggcacttgttcttcacagggcgatagaggtttttggagagtatggctacgaaggaacgtctcttcagggtctgctctctcatttaggcattgcgcgccagagcttgtatgatacgtatggcacgaagcgtgatttgtttttgtccgcggtgaaatcgtatcttgaagggaaaaacgctgcagttatggaaaggcttgaagcgccaggatctgtaaaggaagccattcgtgatatttttcaggaaggtgtcaatgccctgagggatccggaacgggcgaaggcgtgctacattatgaacagtgcgattgaacagatcccgcatgaccctgagcttgcccggtattttgacagacaatccaagcagcttgaggacgctttttatcaggcgcttttaagggcgaaggatcaaggagaattgaatggcgaagatcatgatatatctgcgctcgcccggtacctgaatcagagcaggctgtcactgacatttattgcaaaagtgacggcagatatggatcgtcttaaggaccatgttgacgtgagtttatcagtgcttgattaacatgtggtaaagaatgctttgcccatgtgtgtatttttcggactgaatggtctgaaaataaaaaaagaggtgatgatgaatgttgatgaatgaatttgaaaaagcatgtgaaacattgagaaagtttatggcttatatgcttgagaaggacatgaagagctggatggagctttgggatgagaatgctgtatttgagtttccttatgcgccggagggatcaccaaaaagaatagaaggaaaagcggccatttacaactatattaaggattatcctaagcagatccatctttcttcatttaccactccgacagtgtaccgttcagcagactcgaatacggtgattgcggagtttcaatgtgacggccatgtgattgagactggactgccttatcgccaaagctatatcagtgtcatcgaaatgagagacggccgcattgtgcgttatagggattattggaatccgcttgttgtaaaagaggcctttggaggatcatttttgcaaacagaggagagtgggaaatgatgaaacagaatccgattttaatcacgggcgggactggcacagtcggcagccgaatcgccagccgtttaataaagctgggatacagagtgcgtattgcaagccgaaaaaagggcgcgcttgcaagtgcggagcatgtgtattttgattggaaggatgcctccagttttacgcctgctctagaacaggtaaaagacatctatcttgttgctccggtcggtgtacttgatccggctccctatgtgcttccctttttaaaggaagcaaagcgtctcggcgcaaagcgggtagtgatgcaaagtgcgtctgttgtctccgagaacggtcccgtgtttggcgcgcttcaccaggcagtgcgcgagtttcctgaatggacggtgctgcggccctcatactttatgcaaaatttcatcaatgtccagcatcgcatgtctattcaaacggagggccgcatcacaacggcttcgggtgaaggaaaacttgggtttattgacgctgatgacatcgcagaaacagccgtcagggctttgattgatgatgttcctcatcaaacacatcatattctgacaggtcccgaggcgctgagctatgccgaagcggcggagatcattggagctgcggcgggacgccgggtggagcatgtcagcatttctcgttccgagctgcagcataaaatggaggcaggaggtttgcccgcggattatgcccattttatggcgaagcttgatgaggcaatcagccatggtgcggaacatcgggtaacggatacagtgaagcgtgtgacgggaaaagaacctcgttcgctgtcagagtttgcggctgctcatgctgcatattggaaacactgatctcattttggactaaatagtctagaaagaccttcggcgcttccgaaggtcttcttatttaaaaagctaagtcgtgttttagtcataatcatgcctcctgcctcatacctattaaggtcattgtttttgagaaaggaggagccggaatgaaggatatgcagccgtttacgcctgtcaaatcatatacgccctttcacagccgttttgatccctgtccgcccatagggaagaaatattacagaacgccccctaacctttatatgacctttcagcctgagcacatggagcagttttcgccgatggaggctttgaggaaaggcaccctttggaaggatctctatgatttttatgaaaacccttatcgaggggagacgcacatggcaaaaaaggttgacgccgaatattatcgtcagcttgagcaaatacaggctgctgattttgtgcttgttgagctgagtctttatttaaatacacatcctcatgatgaagatgcgctgaagcaattcaatcaatattccggctattcaaggcacttaaaaagacagttcgaatcctcttacggaccgcttctgcagttcggcaacagccccgcgggcaaggattgggattggggaaaagggccatggccgtggcaagtataaggaggaatgcctgaatgtgggtgtatgaaaagaagctgcaataccctgtcaaggtcagtacgtgcaacccgacgctggcgaagtatttgattgagcagtatggcggagcggacggcgagctggccgcagctctccggtatttgaaccagcgttatacgattcctgataaggtcatcggccttttaacagatatcggcacggaggagtttgcccatttggaaatgattgcgaccatggtctataagttgacgaaagacgccacaccggagcagctgcgtgaagctgggcttggcgatcattacgtcaatcacgacagcgcgcttttttatcataatgcggcgggcgtgccgtttaccgcgagctatatccaagcgaagggcgatccgattgccgatttatacgaagatattgccgcagaagaaaaggcgcgggcgacgtatcaatggctgattgatatttcggatgatcctgatttaaacgactccctgcgttttttgcgagagcgtgaaatcgtacactctatgcgcttcagagaagcggttgaaattttaaaagaagaacgggataaaaagaagattttctaataggcagattggcctctctttcatacacccttttacatacagagaaaatggtctgtttttgcagtttggtctgcattataatcaaggtgtgtgtgcaagcttactttttgattgggaggcctttatgtcagcttttaagattgagaacgaaacgattgcagatggattttacgcgtgtccggccgtctatgaggatgcagaatcgattaccgggttgctcgtccgaacagctgaatggctccgggatcggggttctaaccaatggagcggacttctgaaagggcaagatatacatgatattacggggtcaattgaaaagggacatgcgtttgtgtttaaaaaagatgatgagcttgcggctgtcgtgatgctgctgcctgaaccgagcgagtgggaccggacgctttgggagacgatgggcatgaggagtccatttatttgcatcgcctcgcagtaagccgccggtttgcgggacaggggctaggagcccgcgtccttcagtgggcggagacgggcatacactttccggaaaaaacgcggatccggcttgactgtgtcgctgatagcgacgccctgcattccttttatcggcgtatgggatatgaattcatgggtgctgatgcgtccggatatcatttgtttgagaaagagattacggcagaataagcgtcctttgcagggggcttttttgtcttttctaaaagggagggcaggcgatgtgtggccaatattatttgtgacagggattgtgacggcttgtctgtttgctggcgtatccgttttgatgcggatgagatttcctgacaaaagtcggccggaatggatgttggccgggctgatcgtccttggtgtgtttgcgatctggtacagcctcgtgtatgtacgcggctgggaaggggctgcgctcggaatgcttggattcaatgtcattttcggagccattgccggatatttgatcgataaggccatccggcgttacaggaaaagataaggctgctgccgtctctcatcatgtcgaaattttcacagaccggcaggaattttctttcgaaaggagaaatacatattactttaaaatgaaagcgttttccaaagcaggaaggtgatgttgatgatacacagtgtgacaaatgggctgaatcgtttttgtacgtgggtgatgagactggcctatttgaatgtgctttggattttgttttctcttgcaggcctggttgtgtttgggctgatgcccgctactgccgcgatgtttacagtggcgagagaatgggcgaaggggaatacagatgccccggtgttttctgtcttttttcggacgtttaaaaaggaatggcgggcatcacagatcctcgggcttatcgttgtgacggctgccctgtttctgtttgcggatatgcggatagcggctcagatggaccagcctgtgctcgtcaatgtattcctgagcattagtttgattttcgcgtttgttgtgctgtatgtgttcccggtattttctcattttgacgtaaaaatcagagaggtgctgagcatcagctttttgattgctttcagccgtccggcggtgacacttttgatggcagcgggcgctgtcggtgtgctttgtctcgttctgtttcatgtcacgtttctattgtttttcagcgggagtttactcagcctgatcttaacgaagctgtcctttaaagcgtttcggtcaatggatcagcggcaggagaaagaaaaggcggcatgaagaaaagagttgctggctggtacaggcggatgaagattaaggataagctgtttgtgtttctatcgttgattatggccgtatcctttctatttgtatacagcggggtccagtatgcctttcatgtgtatgatgagcagatttaccgcaagtcctcggaggtgcttcgcatgtcttctgaaaggatcgaagacgagctgaagaagatagaggatgtgtcatatgaaatcattacagacgaacagattcagcgcatcctgagcatgcaaaatcgggatgatacgtatgatcaatatcaaatgaagcaggagctttgggatcagcttgcgggatatgccagtgatgaaaagtacatcgattccattcatttgattgatgcccgcggctcagagtattcagccggaagcagttcttcagatcttttgcagcaggagcaggaagaggtatttaagcgagcgaaagcgaaaaatggaagaaatctttggatgacgctcggcgggtcagatcctgtcctgatttcagcacggcagatcaggtcatatcaccagctgagtctgaacggcttgggcatggtgctgatccaagtcaatgtaaaacaaatgattcgtgatgtgccgaaggattggggcgattcagtcggagacattatgattgccgaccaaggcgggaatttggtgtatacggcacatgcatcagcgcatgttcctgaggcagcaaaagagacgctgaagcaccccggttatgacttgataaaaaagaatggcaaacgttactttatttcttatcttcaatcatcctaccaaaattggagctactataacgttatcccctttgatcagatgttcgcgaaaatttcctttatgaaaacagtgatcggcacatgctttctcctctttttctgtgtggttttgcttttcggaaggaaaatcgccaacagcatcacggagccgattgaacagcttgtgaccgcgatgaaatcggtacagcacggcggtattgaagcaggtgtgtcgctttctctgccggaacatacacaggatgaggccggcatgctgaaccgccatttcactgtcatgatgaaacggattaatgagctgatggaagaaaatgtggaaaaacagctcattattaaagaaaccgaattgaaagcactgcaagcccagatcaatccgcattttttatataacacgctcgagtccatcaattggctggccaaggcgaatcagcaaaagcaaatctcaaaaatggtggaatcgctcggttttcttctgagaaacagcatacatatgaaaaaggatatcgtgaccattcaggaggaggcggacattttacgtcactatatgaccattcagcgatttcgatttgaagagcgcctgaatttcacgttggatattgacgatgaggtgaagcattgcctcattccgaaactgacgctccagccgcttgcggaaaatgcgattcaatacgcgcttgaaccctttacaagaccgtgcgccatccggattcaggcgaaaaaggcgaaggaatgtgtctgtattacggtcgaagataacggtcctggcatggatggacggattcttgaatcaacgggcggaagaggaatcggactttggaatattcgcgagcgcatcagcctgacattcggagagccatacggcttgcggattcatagtgagcatgaaaaggggacgaggattgtgatcacaataccgtgtcgaaatgaggtggtgtgatgtataaaatactgctggctgatgatgagaggattatccttgaaggaatggcgggaatcattgagtgggagtcgcttggcgcctcattgatcggtaaagcgcagaacggacatgaagcatatgaaaagattgtacataagcagccgcatatcgtcatcacagacgtcaaaatgcccggcatggacgggcttgagttgatcaaaaaggtgtcagccatcagtccgtcggtgcaatttatcgtcctgtccgggtttggagagtttgagtacgcaaaggaagccatgaaatatggggtgaagcattatttgctgaaaccctgcaatgaacagcagattatcagctcgctggaggaaatcattgctgagctgaagcggcaagatgtgcacaaaaagaaaacagcccatctgaaacacgagctggaccatatccgttcctttgcagctgatcaatacttggaaggcttgatcgccggtgtggcccagctgtctccgccgccttcacttgccggaaaaaagatccgcctcttgatcttaaaaggggaacaatctattgatgccacagccagagaggcactcgggtcggcactgacagcggttagcagcagcggagaatggaccgtgctcgccgtagtggagaacgccactgaaaaggcggcggaggtttttgcggaccgcaagatggccatcagtcaggcgggagaactccggaacgcggggcagctgtttcgtgacacagccgaagcgtctggtgacctgcacgggagcgcagtgatttcaaaaatgatcaggctcattgccgacgagctcggaaatccgaatctgtccttaaaatgggcggcgaaggatatgctgtttatgaatcctgattatctcgggaagttatttaagcaggaaacaggcgagaaattttcccaatatgttacacgagtgcgtcttgaacatgcgatgaaacagatgaaaatgaggcgggacgcgagtgtatcagaaattgctgaagaaatcggatttggcgataatccgaagtatttcagtcttgtttttaaaaaatataccggtctgacaccgtcagaattcagaagaaaacagggaggcgcttccgcaggatagccatctctgtttttttgactttcgccactgttttttgagtgtttcgccctatccgaacgctttaaaataaaatgtaagcacttacattaaagggggattggtttgaagaagatttgttacgttctgttatcgcttgtctgtgtctttattttcagcgggtgttctgtgggcgaagaggcctcggggaaaaaagaagacattacgctcagaatcgcgtggtggggcgggcagccaaggcatgattatacgacaaaggtaattgaactttacgagaaaaagaatccgcacgtccatattgaagcggaatttgcgaactgggatgactactggaaaaagcttgcgcccatgtctgccgccggccagcttcctgatgtcattcaaatggataccgcttacttagcccaatacggaaagaagaaccagctggaagatttaacgccgtatacaaaggatggaacgattgacgtcagtacaatcgacgagaatatgctgtcgggcggaaaaatcgacaataagctttatggatttacgctaggtgtcaacgtgctgtctgtgattggcaatgaagatttgctgaaaaaagccggtgtgtctatcaatcaggaaaactggacgtgggaggattacgagaagctggcgtatgatctgcaggaaaaagccggtgtctacggttccaacggaatgcatccgcctgatattttcttcccttattatttgcgcacaaagggtgagcgcttttataaagaagacggcactggcctcgcgtatcaagatgatcagatgtttgtcgattactttgaacggcagctgaggctggtgaaagcgaaaacgtccccaacacctgatgaaagcgcacagattaaagggatggaagacgattttatcgtcaaaggcaaatcagcgattacatggaactactccaatcaatatttgggctttgcccggctgacagactcgccgctgtctctctatctgccgccggagcaaatgaaggaaaaggcgctgacattgaagccgagtatgctgttttccattccgaaaagctctgagcataaaaaagaggcagcgaaatttattaatttcttcgtgaataatgaggaagcgaaccagctgattaaaggcgagcgaggcgttccagtctccgacaaggtggcggatgcgattaaaccgaagctgaatgaggaagaagccaacatcgtggagtatgtagaaaccgcgtcaaaaaacatcagcaaagccgatccgccagagcctgtgggaagcgcggaggtcatcaagctgctgaaggatacgtcagatcagattctgtatcagaaggtatcgccggaaaaagccgccaaaacgttccgaaaaaaggccaatgagatattagagaggaataattgacgggaaatggggctgacgcaatgaaaaaaagccggagtataagaaaagacaatctggcgggatatgcttttatttctccgtttatcatcgggttcctatgctttacggtgatcccgatgggggcgtccctgtttctgtccttcacgagctatgacttgtttacggcgccgaaatggatcgggctcgacaactttaaggaaatgtttacgggtgacgaaaagtattggcagtctctgaaggtgacatttacgtatgtgcttgccggggttccgctccgcctcggcttcgcgctttttatcgctgtcattttaaacaatgcagcaaaaggaacggccatttacagaacgctcttttatctgccttcgatcatcggcgggagcgtcgccgtggcaattatgtggcgcaatatttttggcaatgacggggtcatcaatgcgctgctgttttttgtcgggattgatcaaaaaattctttggtaccagaatccgacaagtgcgctgtggacattgattctgctgtccgtctggcagttcgggtcgtcaatgctgatttttctggccgggctgaaaaacattccgtcttcttatttggaagcggcaagtgtggatggggcaaatcgggtgcagcgtttcttcaagatcacgcttccgatccttacaccgattattttctttaatcttgtgatgcagacgatttctgcttttatgacatttacacctgcctatatcatttcgaagggcgagggcgggccgcttgacgggacacttctctattcgctctatttgttccagcgtgcgtttaactattttcaaatgggctacgcatcggcgatggcgtgggtcatgcttgtcattgtcgggctgattacgctcatattgtttaaaacatcgtcatattgggttcattacgagtcaaaggaggaatgacggatggagccggtcaaccagcctgtcagagaagccccggtttttgagagaaaaaaagccgggcgcgtcagtcccaaacgcatactgttccatgtttttacggcaacgctggcggtgttactgctgtacccggttatttggctgtttgtcagctcgtttaaagaaagcgccagtatttttacaacctcacattctctcattccagacccttttattctcagtaactatgctgaagggtggaagggcattgcgggacagccgtttctgacgtttattaaaaactcggcgattattgtcgggctgtcaacaatcggtgccgtcctgtcatcggctgtcattgcgtacggatttgcgcgtattccgtttaagggaaaaaaattttggtttgcgtgcatgatggggacgttaatgctgcctcatgaagtgttgatgattccgcagtatattatgtttgcgaaattagactggctgaattcctttaaaccaattgtcgttccgcaatttttcgggcatgcgttttttatctttctgatgatccagtttatccggacgattcccgaggagctggatgaagccgcgcgaatcgacggatgtgggcgctttgcctgcttttggcggatcattctcccgctgattgccccggcgcttgcgacgtctgcgattttctccttctattggaagtgggaggagctgattcagccgctcttgtatttgaataagccggagctttaccctgtttcacttgcgctgaagctttttctcgatacagagtcggcttcgaactggggcgcgatgtttgccatgtcggccgtctcgttattgcctgtgattcttgtattctttttgtttcagaaatatatcgttcagggcatcagtacgaccggattaaaataaaaaggagtgttgcagatggcacagcttatctttgatgaagaaaaggtgacgtcggttattgaccggatcgtgaaacggacatttcagatggattttgcgtgggattggccgggcggcgtcgcgttttacggcgtggcggaggcctatgaagcgacggaaaacgaggaatatatcaatctgttaaaaacgtgggtggatgaacagctggaggatgggctgccgccgctttcaatcaacggagtttccatcgggcatacgcttttgttcctccacaaggtgacgggtgatgacgtgtatttggaaacagcggccgagatggcggaatatgtgctgcataaggcgccgcgctttggcgagggtatccttcagcatacggtgaatgcggcagaatatgtgtttcctgagcaggcatgggcggatacgctgatgatggctgggctgtttatgctgagaattgggcgggtcatggagcgtgaggattattttgaagacggcctgcgccagtttcacggacatgaggatgtgctacaggaccctgtcacgaatttgtactaccacgcctgggacaacaaagcgcaaaatcatctgtcggggatttattggggcagggcgaacggctgggcggcactcacgatggcaaaggcgctcccgctcattgaggtgacacatccttcctttatgatcatcgacggatcgctcagagaccagctgagcgcgcttgtccggcttcaggatgaatcagggctgtggcatacgattttggatgatccggattcttatctggaggtttcggcatcagcgggtattgcttctgctctgatgtcgagcggaaagctgtatacaaaatatgtgcagaaatcgcttgccgccattttggatgcagtggaagaggacggacgggtcagcagggtatcggccgggacagccgtcatgaaaaatgccgaaggatacaaacaggtgccttacaaacgaatacaaggatgggggcagggacttgcgctgacgtttcttgctgatgttttgaaaacgaaaaaacgcgtgtatcagtaaagacagcggcggggggaaagggatgaaaaaacagcctcaacagaaggaacgggtttctcgctggaagggaacgtatttcaaaagaaactttgtcttcattttgctgattgcctgtattcccggattgctgactggcggcgcaatctactttctttcgatcgacaaggtggagaaagagctgcagagatcgcatgaaacacaggtggcgcgtgaggtcagccgaatggatgagaagctgggagtgcttgaactggcactcacccagatggcctacgattcttcactgatgaatggattggccgagagggatttggagaaagactttacgttctcctatcaattaacgaaaaagctgtttcttttgcgggaccagcagccgctgatcgagcaggcttccatctttctgaacagcccccggccacttgtgctgagccctgaatacagcgctttgacagaacaggaggcgcttcgcaagtatcgctcgctgcttgcctcagaccgcagcatttattggaaacggtcgggaaaccaagcgatgctgatccagctcattccgggcgcggcggagaaaccgttcggcgcgatcatgctggcggttgatccgaaagaaatggaatcaatcctgcaaagcttgtccccctatcctgatggcagtgcgctacttttagatcaaaatcaagaggtgctgtttcatgaaggggaaaaagattttgaaaagactttacttcaagagataaaaaaacagcctgctgagaacggccattttcagttggaatgggaaggcaaggtgtattctgtctcctttggagaaatgaaccggatgcatcagcaatggacctttgtgtcagcggcgcctctttcagctattacagcgccgatggtgtttttatcaaaagtgatcatcgtgatgctggtcatttgcatcggtttggcggtatgcatgacatggtatgcatcaaaaaaaatctatcgtcccattcagcatttgcttggcttgtttaccggaggagagaagaaagtatggcaggcgtccgggcaggatgaattcaagtggattgaaaagagatggcaggatctatcccttgaaagccggaagctccaagagcagctcctgcggcagacgccccatatgaaaaagagttttttgcagcacctcttgcagggggatttttactatgacaacgaggacagtctcagatctcggatggaggaggccggctggaacatcggcgaaaacgtgtttcatgtgctggatcttcaattgacaggactccgctgtgaaaaaagcatcttctgttgcgatgatgaacagctcgctgtgtttacactgactaatctggctgaggaattggcggataaacgcgtttttcagctctccatacttgatatcggccggctttctatcaccgttcttgtgatgaaaacaaacagctctgatctgaaggcgtatataacggagctggcacgccaatttgggaatgtaaccggactatgcctgacctcgacattgagcagcgagacggagcgtgtcacggaaattccttctttatttcagaatgtgaaaagcggcaaatcctgcaggcagtttgccaaccggaatcaggtcattgatttgcaggccgacttccctcaggatgagcagttcgctccttattacccttttgaactggaaaaacaaattgttcaggctatccggctggaaagaaaacaggaggccgaggaactgattcgtgtatgcatggaggaactggcggaaaaggcagccatagacaggcatgtgcattccgccctgattcagctgttttcccgcattcaggaggatattttgcattccgggctcaatcccagcgaactatttcagcaccggaatccgtttcttgatatttcagaattgcgcgaacctaatgaagcggcggcctggctgatggatgtagtggtgacgccttacctttccaagcttgagggcagaaaaaacagacagcaaaagcagctggcagaacgtgtgattgcgatgattcacgaacagtatatggcggacatttcattggaaagctgtgccgatgcgcttggcatgaattcatatacgttaagcaaggcatttaagcaagtgaccggcattaattttatcgattatgtgacccagatcagaatcgaaaaggcgaaagaactgctggtcaatacgaataaaaaaattcatgacgtgtcagaagaagtcggctaccgccacaattactttaaccggatttttaaaaaacaggtcggcatgccgccgggtgtcttcaggcaaatgtatcaggaaacgccgtgaaaggagagaacatgtgatgaagaaaccgattcaagtatttttagcgggggattccactgtgagtgactgcccgcctcatgaagcgccgatggcggggtgggggcaggtattcgggcaattgttttctgaagaggtagtggtgcacaatcatgccaaaggaggagcgagcaccaattcttttgtggaggaaggaaggcttcaagcaattgccgaatgcatcacacaaggcgattatttgttgattcaattcggccacaatgaccaaaaaccgcggggacgaagccgtactccacatttcagcagtttcttaccttgtttgcagatacggcacgcgaaaagggcgcgcatcctgtgttcgtcacatcggtgcagcgccgccgctttgatgaaaacggacggatcgagcattccctcggtgagtatcccgatgcgatgaaagcactggcgaaggagctcgatgtacctgtgattgatctgcttgcgaaaacaaaggtgctgtatgaagaatacgggccggaggagtcgaagcgattgttcgtttggtttcagccgaatgaacatccgaattacccggacggtattgaggacaatacgcatttttcggaaaaaggtgcaatggaggttgcgaagcttgtggcagaaggcattgaagagctcggacttccgcttaaggaccaccttgtgagccgggagggaaaagaacatgtataaggaaggcgcgtgcctgtaccgcaatccgctccggtctaaaagcgatgtgaaggactggcggatggagggaggcggacagatctcatttgatgatcacagcttgcacctgtcacatgtccaggacgatgtgcactttgtcttttggtgtccggaaacctttccagacggcatcattgtgacatgggacttctctccgatcgagcagccgggattgtgtatgctgtttttttctgctgcgggaatgggaggcgaggatttgtttgatccaagtctccagaaaagaacgggaaaataccccgagtatcattcgggggacatcaatgcgctccacctgtcgtatttccgcagaaaatacgcggaggaaagagcgttccgcacctgcaatttaagaaaaagccgtggtttccacctcgccgcaatgggggccgatccgctgccttctccagacgacgctgattctccgtatcgtatgaagctgatcaaagacaaaggctatgtgcacttttcaatcaatggtctgcccattcttgagtggatggacgacggcagcacatatgggcctgtgttaacaaaaggaaaaatcgggttccggcagatggccccatgaaagccgtttacagggattttgccgtacatcaagcggtgagaagatgaagacgactgtaacggatgcgctttatgcaggctccgaagcggtggtgaaaatagcatggctcaacgggctgtggctgttgtttacacttttgggcggcgttcttttcggatgggcgccgagcacagccgcgatgtgtgccgttataaggaaatggctgatggggcaaaaggatgtcccgatatttccgttatttctcgatacctataaaaaagagtttctcaaggttaatgcgatcggattggcgttttcggctcttttgatcatattgtctgccaactatcattatttttctgccagtacgaattggctgtcctttgccgtaacaaactgcacgctgcttgcagggcttttgtatatcatcgcgctgatgtatgtgtttcccctttatgtgcattaccagctcccgcttcgcaaatatattccgcaggcactgctgtttggcgccatgagaccgctgacaaccggctgtatgctgatcgggtgcggatttgtcctttatttgctttatacgcttcctggcctgatcccattttacggcccgtgtttatttgggcttgtgttgatgttttttgctcttaggggatttcaaaagacggaggcccagcaccatcaagccgggtaacaaaaaagtgacaaatacgcaaaaaagtgaagtgtccgaaataggcagatgcaaaaaagtgaaattgaagacagctcacacagcgcataaaatccaatttaagtaagcgcttacagataaatgagaaggagctgtctgatgattacacgaaggaaacgcatgtttaccgctgttacgttgctggtcttgttggtgatgggaacctctgtatgtcctgtgaaagctgaaggggcagcgcggcagatggaagcgctgaaccgggggcttgtagcggtcaagacggacgggggcatttttgtcagctggcggtttcttggaaccgaaaacgcatctgttttgttcaatgtgtacagagacgggcaaaaactgaatgctgcgcctgtcaaaaccacgaactatgtggataaaaatggatcggcgggttcgacgtatacggtccgggctgttgtaaacggtaccgaacagccggcttctgaaaaagcctccgtatgggcgcagccgtatcattccgttccgctggataaaccggctggcggcacgacgccaaagggtgaaggttacacgtacagcgctaatgacgcaagtgttggcgatgtggatggtgacgggcaatacgagctgatcctaaaatgggacccgtctaactcaaaagacaattcacaggatggctatacgggtgacgtgctggttgacgcgtataaactggacggcacaaagttatggcggatcaatctcggcaaaaacatcagagcgggcgcgcactacacccagtttatggtgtatgaccttgatggtgacggaaaagcggaagtggcaatgaaaacggcagacgggacaaaagacggcacgggcaaagtaattggagatgccaatgcagattacagaaatgaacaggggcgtgtgctttcaggccctgaatatctcactgtgtttcaaggttcaaccgggaaagagcttgtcaccgcaaattttgaaccggcgcgcggcaatgtgtcggattggggagacagctacggcaaccgtgttgaccgttttctcgccggcattgcctaccttgatggacagcggccgagcctgatcatgaccagagggtattacgctaaaaccatgctagttgcctataacttcagggatggaaagctgtcaaagctttggacgctggactcctcaaagtcaggaaatgaagcgtttgccggacaggggaatcacaacctgagcatcgcggacgttgacggggatggaaaagatgagattattttcggctcaatggctgttgatcatgacgggaaaggcatgtactcgaccggcttaggccatggggatgccctccatacaggagatcttgatccgggccggccggggcttgaggtgtttcaagttcatgaggacaaaaatgcaaaatacggcttatctttccgggatgctgcaaccggaaaaatcctttggggcgtttatgccggcaaggatgtaggccggggaatggctgctgatattgacccgcgttatccgggacaggaagtgtgggcaaacggttctctctactcagcgaaaggggtcaaaattggaagcggggttccgtcctcgaccaacttcggcatctggtgggacggcgatctgctccgggaacagctggacagcaaccgaattgataagtgggattatcaaaacggcgtatcgaaaaatgtgctgactgcatcaggcgcagcggctaacaacggcacaaaagcaacaccggcgcttcaggctgatctgctcggtgactggcgcgaggatgtcgtgtggagaacggaggacagcagtgctctgcgcatttacacgacgaccattccgactgagcacaggctgtatacgttgatgcacgatccggtgtaccggcttggcatcgcctggcaaaatgtcgcctataaccagccgccgcacacaagcttctttttaggagacggcatggcggaacagccaaaaccaaatatgtatacgccttaactgaaagggggaaggaacgggctgcgcgcagcccgttcccatcaaatgaaaccaaaaaagaggcaaatggaatacttgaccagaggtttgattgcggtaaagacagatcagggcgtgtttgtcagctggcgttttctcggaacagatcatgagacgacggcttttcacctttatcgggatggaaagcggatcacccgcgatccaatcgctgaaagcactaattttctcgatcaaaacggaacggctgactctgtttatcaagtggcggctgtcaataaaggacgggaagaaaagctttccaaggaagctcgtgtttggcaggaaaatgttctggaggttccgcttgccagaccggaaggcggtgtgacgccggacggaaagccgtacacttacagagccaatgatgccagtgtcggggatgtagacggggatggagaatatgaaatgattctgaagtgggacccatccaattcaaaagacaacgctcatgacggttataccggggaggtgctcatagatgcctataaactggacggcacctttttgtggcgcatcaacctcggcagaaacatcagggcgggtgctcattacacgcaatttatggtgtatgacctggatggtgacggaaaagcagaaatcgccatgaaaacagctgacggcacaacagacgggaaaggacatatcatcggtgatgagcatgccgattttagaaacgaacagggcagaattttgtccggtccggaatatttgacggtgtttaaaggagaaaccggtgaggcgctcacgaccgtggaatatgaaccgccccgcggcaagctggaggattggggagacggctatggaaaccggatggaccgttttctcgccgggatcgcttatttggatggggagcggccgagccttgtaatggcgcgcggctactatacgagagccgtgctcgtggcatacgatttcagaaacggaaggctcaaaaaacgctgggtatttgactccaaccagccgggacatgaagcgtacgcaggacaggggaaccacagcttaagcgtggcggatatcgacggagacggaaaagatgaaatcatatacggcgcaatggctgtcgatcatgacggaaccggcctgtactcaacggggctcgggcacggagacgcgatgcatgtaggggatctggacccgtcacgaaaagggcttgaagtgttccaggtgcatgaggatgccacgaagccgtacggactgtcactgcgagatgccggaaccggtgagatattatggggcgtccatgctggaactgacgttggccggggcatggcggctcatattgacccaagctacaaaggatcgctcgtctggggaattgatccgccgggcaatgatggcatgtcgtatgggctttttacgagcaaaggcgaaaaaatcagcgacaaagcacccgcttcagccaatttcgccatctggtgggacggtgatttggtcagagaactgcttgatcatgactgggacggaacgattggcaggccaaagatcgaaaaatgggatgctgaaaacggctgtctgaagacgatatttcagccggccggcgtgctgtctaacaacggcacgaaaggaaacccggttcttcaggccaacctgtttggagactggcgggaagaagtgatatggagaacggaagacagcagcgcgctccgtatctatacaacgacacatctcacccgccaccgcttttacacgctgatgcatgatccggtttacaggctcggcatcgcctggcagaataccgcctacaaccagccgccgcacacgagcttttacctcggaacgggaatgaaaaaaccgccgaagcccgtcctgtacatagcgggaagcaaagcggaggcgccgctataagaggaataagggataagacgcaaaggctgaacgctacgacgagatgattaacgaacgggcaggacgaaccaatgctcaagcgctgtacgcaccggtttttttcaagggaagagctatccgtgatggaagctgtataaaaacgagggggaatgaaaaatggcaaatcatatttatcttgccggcgattcgactgttcaaacgtatggagacagcacaaatcaagggggctgggggcagtttctcggctcgcatctgccggagcatattcaggtgatcaacagagcgatcgggggaagaagctcgaaaacatttgtggaagagggcaggcttcaggcaatcctcgatgtgatcgagccggatgattggctgttcgtgcagatgggccataatgacgcgtcgaaaaataagccggagcgctacaccgagccctacactacttataaacaatatttaaagcagtatatcgcaggcgcgcgggaaaaaggcgcccatccgcttctcattaccccgtagcccgctttcattacgaaaacggcgtgtttttgaacgattttccagattactgcattgccatgaagcagacggccgctgaggagaatgtccagctcattgatctgatggagaaaagccttgctttctttactgagaagggcgaggaaaaagtatacacctattttatgatttcagaagggattaacgattacacgcattttacaaaaaaaggcgcaaatgaaatggcgaaacttgtggcaaaaggcataaaggagctcggcctgccattgacagaatcgatcatcaaagaaaggtgaaaatgtgatgagaaaactgtatcatggcgcttgctattatccggaattatgggatgaagagacgattcagcaggacattgacatcatgcgtgaagttggcgtaaatgttgtgcggatcggcgaatttgcctggtctgtcatggaacctgaagaaggaaaaattgacgtcggttttttcaaagaaatcatcacccggctgtatgatagcgggatcgaaacgattatgtgcacgccgacgcctaccccgccgatttggttctcacatggccggcccgaacgcatgcatgccaatgaaaaaagagagatcatggggcatggctcccgtcagcatgcctgtacgaacaacccgtatttccgaaaaaaagccgccatcatcaccacagccatcgccaaggagcttggccggctcccgggctgatcggatggcagctagacaatgagtttaaatgccatgttgcagaatgcatgtgtgagacatgcttgcgcctatggcatgactggctcaaaaatcgctacggggtaattgagcgcttgaatgaagcttggggaaccgatgtgtggagcgagacctatcagacgtttgagcaagtcccgcagccgggaccggccccgtttctgcatcatgcctctctacgcactatgtatcagctgttttcgatggagatgatcgcttcgtttgcggatgaacaggccaaaatcatccgctgctattcagatgcgccgatcacgcataacggatcagtcatgttcagcgtggacaatgaacgaatgtttcagaatctcgattttgcctcctatgacacgtacgcttcgcaggaaaacgcctctgcctttttattgaactgtgatttatggagaaatctgaaacagggacgcccgttttggattttggaaacgagtccgtcgtatgccgcctcgcttgaaagctccgcttacccgcacgcagacgggtatttgcaggccgaagccgtatcgtcctacgccttagggagccagggattttgctactggctatggcgacagcagcgttcaggtagcgagatttcccacggttcggttctcagtgcctggggcgaacccaccatcggctatcaaaatgtgctggcggttgagcgggcaagaaaggaaatcgagcctattattctatcgactgaacccgttcaagccgaggcggcgatgacttactctgacagagcaaaagcatttattaaaactgagcctcaccggggactccggcatcgttcgcttgtgacgcatttttatgaacgtattctcaacacggggattcatcgtgaccttattccggaaggcgctccactggacggctatcgcttgctgtttacgccatttgtgccgtatttgtcttctgaatttatcaaaaaagcttcggcattcgctgaagcgggcggcatctggatcaccgggccgctgacaggagggcgcacatgtgagcataccattcataccgattgcggacttggcgaacttgagaaaacgtcagggatcaaaacactttttacctttccgatgaatgagaacgtgaatacaggaaaagcgtttggcatcacggcgccgctcggactgtggagcgcggtgtttgacacagagagcggaaacacccttggcacggttgaagcaggaccggggcgggccatgcttttctgacggaacggaattacggcgaggggaaaattgtcatgctgggctcgcttccatccggaaaagaaggggatgcgatgctggaagcgctcgtcaggcattatgcggaggaagctgttatttccagccggtcggatgtgacacccggcacgatcgttgccccgcgtataggcgaaaacggccttgtgtggatcgttgtgaatatggatggaaaaggcgggagcgtgacattgccggaagcgggaatggatttgttgacgaactgtttgaccaaagcggggagactggcagtcggaccgcatgaataccgtgtgattcaatttgacaatcacagctgattctttgcatcgaatcagcttttttctatggagggagaggccgatgaaaaagatcaaatggttatcagaacagccaaagttgacaagcggcgtgacgtggggcgtgccatggaaaaaaggagaattaaaaaaaggagaccgtctggcgcttatgaatgaaaacgcggaaacgcgatatgtgcaaagcgaaccgtcggcctattggccggatgggagcatcaagtggacgaagcacgcggcggtgtttggcggtcaggaaaaccaaagctttacagttcgcaaaagagaagtgccgcagccaactgaatcgctcagcattcatgaggcagagcatgacatccaagtgaatacaggagcactcgtttgtaccattcataaaacaggatctgatttcattcaatcattgcagatcaacggaaagccgatcgccgcaggcgggaggctcgttgcgataagagaaacgagaaaggagtcggcggcggaaacggttcttttgcatgaaaggtctgtcagctttatcaaacgggcggcgattgagcagagtggtcctgtcaaagcagtagtcaaaatcgagggagtgcatgtgctccataaaacgaatgaggaatggctgccgtttgtcatccgattgacgttttatgccgggctgtctgagatcggccttgtgcacacgcagctgattgacaggagcggtaaacaagaattcataaaggggctcggcatcgaatttgccctttttttggagggagagccgtacaaccgccatttccgctttgcgggagagaaagggatgtataaagaacccgcccagctgtttggcacacgtaaattcaatgaacgatatccgctttatgaaaaacaaatcaatggcgaaatgctgtctccagatgaagagcataaggaatggtttgcacatggcacacagaatgcggtttgggacgatgtcaagctcgtgcaagattccagcgatcattacagcctgtcaaaacggaccggaaaagattatgcgtgggttggaatgctgcatggcagccgggcgaaggggctctgctatgcgggtggaaaaaatggcggtgtggctctcggcctgcggtatttctttgagaaatatccttcagcactggaaatcacaggtcttgccggcagccgccccaaaatgactatctggctttggcctccggacggcgaagcgatggatttgcggcattatacaggaaacacccacgtggccagcgcgtatgaaggctttgatgaaatgcgctctgatccgacaggcattgcgaacacaaatgaaatcagcctggcgtgcttttcgcacatgccgtctgacgaagtcctcaatgcgctggctgacaaatggcaggcgccgccgctcattgtatgcgagccggacgtctattacgaatcaaaagcactcggggtatggagcatcattgacacatcccatccgctcaaaaaagagctggaagaacagcttgatgcggcctttctgttttataaaaaggaagtagagcaacgcagatggtacggtttttggcattatggcgatgtcatgcatacgtatgacccgattcggcatatgtggcggtacgatctcggcggatacgcatggcaaaacaatgagctcgttccgaccctatggctgtggcaggcgtttttccgctcaggcagagaggatatctttcgcatggcagaagccatgacccgccatacgagcgaaacggacagctttcacctcggtgaatacgccgggcttggttcacggcataacgttgtgcactggggatgcggctgcaaggaagcgagaatcagcatggccgggctttataaattctattattatctgacgggtgatgagcggacgggagatcttttgacagaagtgaaggatgccgattatgccctcgtcaaaaccgatccgatgcgcgctttttacgagaaaggcaagcacccgactcacgccagaacgggaccggactgggcggcgttttgctcgaactggctggcggaatgggagcggaccgaaaatccggaatatcgcaaaaaaatcgaaacgggaatcaactgtctgaagcggctgccgctccgcttattatctggcccgacatttgaatatgatccggcgacctcgatgcttcatcatatgggagacggcattgcgggcggatatcatatgatcattgccttcggcgcgccgcaagtgtggatggagctggctgagcttcttgatgactgggaatgggaggatatgctgagtgaattcggcgaattttacacactcagtgatgaggaaaaacgaaaaaaaagcggagccgctcttcatgacgggcattttcactggccgatgttcgccgccggtatgacagcctacgccgcaagaaaaaaacaagatcctcatctcgccgccaaagcgtggaatcttttgctagaagataagctcagccatacgccgcttccgatcaaaccggagcgcatcgagacatggacgcagctagaggagcttccatgggtgacaacgaacactgtctctcaatggtgtttaaatgtcatagcggcgctggaactgatcggagattcccttccggcaaaaaaagaaacatcgggcaaaaaaggataacagccggaatttcataggagaaatggtgcaaaaaatgaagattgcaagaatttatgtaagcgctttatattgagaggggcaaaggggaaatgcaaattgaaaaaaggggacttacgcaacatgaaaataagaatgcgaaaaaaatggatggccttgccgcttgctgccatgatgatcgccggatgcagccattcggaaacatccaattcagcaagcggttcgaaagatacgatcaaaattatggcgccgctcttatcgccggaaagcccgagtgataagagcccttcattaaaagcgctcgaaaaatacacaggcaaagagattaaggtcacatgggtgcctgattcatcctacaacgacaaattcaacatcgtcatggcttcaggagagatgcctcacgcgattgtcattaaagataagtcagccggctttatcaagtctgtcaaagcaggggcgttttgggaactgtctccttatttaaaagactacaagaatttaagccaggcagatgaaaagattttgaagaacagctcggtgaacggcgaggtgtacggaatctacagaacgagggatctgatcagggcgtgtatgatcatcagaaccgactggctgaaaaatgtcggtctggatatgccggaaacgcttgatgatttctatgaagtgctgaaagcctttaaggaaaaagatcctgacggaaacggcaaggatgatacgtacggcatggtcgtgccgaaatggatgggactcggcaacggaagcccatgggatgttctgcaaatctggttcggcgctccgaaccgctacggtgttgaaaacggaaagctgattccagattttacaacgaaggaatacatgaatgcgctcacgttttttaaaaagctctatgatgagggattgatcaataaggattttgctgtcatggattctgcgaagtggaatgatccggttgtaaaaggaaaagcgggtgtcatcgttgatacaggctcaagagcgtctcaaatccaaagcgcgatggaggaggcggatgagtcgaacaaggatatcattgatatcgtcggctcgcttgagggaccgaatggcaagcgcactttcccgacatctggttattcaggcatgatcacgataccaaaatcaagcgtcaaaaccgaaaaagagctgaaagaggtgctgtccttcctcgataagatgaatgataaggaagcgcagattctcacgaacaacggagtgaagggccgcaattacgagctcaaggacggcgtattcacctcacttgaaaaaaacaacaaatctctcctgtatgagcatgaaggcttggcacagttcagcatgtcgattccgaaaagtgagtattacatcgaagaccagaaaaccaagctcttccagcatcgcaaggacatcataaccgaaggagaaaaaatagccgtctttaacccggctgagtcgcttgtatctgatgtctatacccaaaaaggagcccagcttgacaacatcatcctcgacgcgagaacacaatttatcattggagaaattgatgaaaaagggttcgctgatgcggtggagctttggaaaaaaagcggcggcaatgacctgatgaaggacttgaacaaattgtaccaatcgtcaaaataaaccgatgcgcctgcctttcggcgggcgccccggtatcacgaaaggagaacagatatggaaacagtgccgaagaagggagattcacctgttctcaccgctggaaaaggcatcagctggatggctgcgctcaaacgggacaaatggctttatcttcttcttattcccggtctgctttattttttgatttttaaatacttgccgatgtggggcgtgctgatcgcttttaaagactactcgccatatcttggcttctggaaaagcgaatgggtcggctttgattatttcaaagacttttttatgaatccggattttttccggctgctgcgcaacaccctcatgctggcgagcctggatcttttgtttgcctttcccgcgcctctcattttagccctgcttttgaatgaggtaagaaaggccgcgtataaaagatgtatccaaaccttcatttacgtaccccattttgtatcatggacaattgtggtcagcatcaccttcgttttctttactgtcgatacaggtgtgatcaacaaaatgatcatgagcctgacaggtgagcagatttctttcttgtcggatgcagactggttccggccgatgattgtgatgcaaagcatttggaaggaaacaggctggggaacgattctatttttggcagcgcttgctacggttgatcaagagcagtatgaagcggccatcatggacggagcggggcggttcaggagaatgtggcatattacgctgccggcgatcagaagcaccattatcgttttgttgattttaagaatcggcagctttttgaatcttggctttgaacaggtgtatttgatgacgaactcactcaaccgcagtgtcgctgacatcttcgacacgtatgtgtacatgatggggattacccaaggggcgtatagctacagcacggcggtcggtttgtttaaatcagttgtcgggattatcttgatttttggcgccaattacattgcgaaaaagtttgatcaggaaggattgttttagaggagggagaggtatggctgaaattcacacgatgcacaacaccaaagccggacggatgtttgacgtctgcaacattctgtttctcggcggtgtcggagcgattaccattttgccgtttttatatattatcgccggttcctttgcaacagaagcggaactcgcccagcggagcttctttattttcccgaaaacctttacacttgatgcttacaagtatgtgttttcgacaccgacgttccttcgaagcatgggcgtgtccatcttcatcacggtggtcgggacggctgtacagctgtttttcaccttcacgatggcgtatccgctggcgaagcggcatgtgaagggacggaatctgctgttgaatctggtgattttctccatgctgttttcaggcggcatgattccgacgtaccttgtcgtaaaatcacttggccttttggatacgtattgggcattgattctgccgatggcgattaatccgttcaaccttattattatcaaaaacttctttcagcagctgccgcgcgagctggaggaatcagcaaaaattgacggctgttccgaaatcggcgtcttctggcggatcgccctgccactgtcaaagccagttattgcgacctttgcgctgttttatgcggtcgggatttggaatgatttcttccacgctctcttatatatcaatgacagtgcaaaatggccgctgcaaatggtgcttcgccaagtcacaattttatcggatttaacggcgaccaatggtgatacgatgcaaaatgcagttccgccggagcagggaattaaactcgctgtcattgtcattgcgacgctgccgattttggcggtctatccatttttacaaaaacactttgcaaaaggaatgctgatcggttcggtgaaaggctgagaaagggagtgtttcatatcagtacattagatcagattaagattgcctatatcggcggggggtcccaaggctgggccagaagcctgatgagtgatttgtcgattgatgaacggatgtcaggcacggtggcgctctatgatcttgattttgaagccgctcagaaaaatgaagtgatcggcaatcacagcgggaacggcagatggagatatgaggctgtttctactttgaaaaaggcgttatcagccgcggatatcgtcattatttccattttgccgggatcactggatgatatggaagtcgatgtccacttgcctgagcgctgcggtatttatcagtctgtaggtgatactgtcgggcctggagggatcatcaggggcttgcgtgctgtgccgatatttgcggaaattgcccgggcgataagagactacgcacctgaatcatgggtgattaattatacaaacccgatgtctgtctgtacaagggtactgtataaagtgtttccaggaatcaaagcgattggctgctgccacgaggtattcgggacgcaaaagctattggcggaaatggtcacggaaaggctggggatagaggtgccgcggcgtgaggatatccgcgttaatgtgctcggcattaaccattttacatggatcacaaaagcctcttaccgtcatattgacctgctgcatatattccgtgaattcagcgcgcactatggggaatcaggatatgagctggagggggaaagctggagggacagcgtcttttgttcggcacaccgtgttgcgtttaatttatttgaaacgtatggcgccatccctgctgcgggagacaggcatctggcagagtttcttcccggcccatacctcaaacagcctgaagtatggaaatttcatctcacacctatatcattcagaaaacaagacagagctgagaaacgacaagaaacagaacggttgatcgtgcaacaacggggcgttgctgagaaagcttcgggagaagaaggcgtgaacatcatagcggctcttctcggattgggtgaactcgtcacaaatgtaaatatgccgaatcaaggccaggtctcaaaccttcctatacaagccattgtcgaaacaaacgcattcatcacaaggaaccgtgtccagccgattttgtccggagcgcttccgaaaggtgtggaaatgctggcggctaggcatatatccaatcaagaggcagtgtcggacgctggtctaacaaaggataccggcctcgcgtttcaagccttcctcaatgacccgcttgtccagattgaccgcagtgatgcagagcagcttttcaatgacatgctccaatgcaccatgcaacgttgagcggagcttttccggtttagaaaagaaaccattgaccatactgatagtataatcaagaagtaggtgctatcaatatgggagattatttaagtgttgcggtagaattggtctgcggtttaggcattttatttattatcttaaagcttctcgggaaaacccaattttctcaaattacgccgtttgactttatttctgctttaattttaggagaattggtcggaaatgccgtctacgatcatgatatcaaaataaaagaaatcatttttgcttcgctgctgtggggcgtgctgatttatgttattgaatttatcacgcaaaaaatgaaatcatcgcgaaagttcttggagggtgagccgaatatcgtcatccgcaaaggagagcttcaatataaagtaatgaagaaaaataagatagacattaaccagctgcaaagcctattgaggcaagcggggagtttttcgatccaagaagtagaatatgcgattttggaaacaaacgggatggtcagtgtgctccccaaatcagactttgacaaaccgacaaataaggatttgcagattccttcgaagtccgtttctctgccgatcacgttaatcatagatggagagattgtgcgggataatttgaaggaagcaggtgtggatgaacagtggctgaaacaagaattgaaaaagaagaacattgataagacagaggacgtgttatttgcagaatggcataaaaataagccgctgtatactgtaacgtacgaacaaagcagatcaacatgactcttagaaaaaagcttgcagcaaggcgcaagctttttattgattgtatgtcccttgtttgacagcacgtacatggtacatgctcacttcagtgctgatcagatagtcaggctttggtttgcctttgtttgctttatggccggcgatatgcgcatcgcttttttcccattgcttccagtgatcctctgattcccagcgaatcatgacaacaacttcttcatcaccgcggcgcacatttttctcaagcactgtcacatcaattaaaccttcttgtttttcaatgattccttcagcgctgaaacgttctataactttatctgcaaagccttctttaaccgtcatttttctcaactgtacaaacatttgtctcactccaatcattctcacatatgaataattgtaaatgaaattcattctcaatgtcaaagaaagcgcaggacggaatcgaaccgccgtgcgcaacagtttattcttttaataaaaacacatttccgtcttcgtccttaaattgaacgaaggtgccccactccatttgattgggctcaccgagaaattctacaccgtttgtcttcattttctcgtatgtaccaaagatgtcttcgcattcaaacacaatagaagccttcatttgctctgagcctttcatcatggctttcgggtaaatgactaaacgagtctcggccccttttggcgcaacctccagccagcttgcttcaggtcccattgggtggtccgctgcaatatcaaagcctaccttctctgtccaaaattgcttcgctttctgctggtcctcgacatatacagcaacagtgccaatttgtttgatcatagggaaacctccaagttgaaaagataataatactataacctgtttacggccgaagtaacataaaaaaatcagccggaaaccggctgatttttaaaatgagcagcttacaacatcgatgtgatttgtgtctaaggcgaaataaacccagcggcgacgtgaggaatcccaataaaaaccgccgacggatcttctgccaaggatgatcgggtaaaaccaaaaggagcggccattggttaaccaaacataggtaaatcggaaaaggcaaggacgaatggtgattggttcaactaacaaaacggctccttgagaaccctgcggttttgggggtttcgctggtatttgggaaggaggaggtccctgcggcgcaccgccgaagcctgggctggcaccgctgccaataccagggccggagccgccgccaaagcctggaacagcgccaccgccaataccagggccggagccgccgccaaagcctggaacagcgccaccgccaatgccagggccggagccgccgccagagcccggaacagcgccgctgccaatgccaggccatggatatcggtattcatattcaaaagcaggccaaggctcataaaaatgccccgcaaacatataaggatcaacataatacatgtgataacgtcctttctcattgtaaactgtacattgcagtttatgcgggcggactcttattggtgcattcgcctaaggatatgaagcaggaatgctctcagagagcagaatcatttgatttttctctagtcttattcacaattccgatttatcattttataatgaaagtgcttctattacgaaaaaggagacagaccgtgaatatcgatcaattattatatcaatatatcatagacaacactgcggatattactgagaaatggttcagtttgcgttgccagctaaaaggcgagctatattccgccagccatttaagtgaagaaacgaaaacacttttaaccgagcagcatacatttaccaatataacaatcgcaagcgcatttctggaggatcaaaccgattttcaagaaaacatgacaaaatgggcgcaaaacgttgcgaaaaacagggtagagcaggatgttcaagttcatgaggtcgtagaagccatatccaattcaagaatctcattctgggacgcagtcgtcacatttataaaagagaatcaggagattgtgacaaatgaggatgcagaccgatggaaccgcattgtgaatcagtcgttcgataagctgattattgaattctccgagcagtaccaaaaattcatgctgatgaggcttacatctcagcaggaactgatctcagagcttggctgcccggtcatttccattgccgatggaatcgggatattgccgcttatcggctccattgatacaaaacgggcacaggtcattttagaaacagtgccggtccgctgtgtcgagagaaaaatcacaagcctcgtcgttgatctttcgggtgttccgattgtggataccatggtggctcagcaattgtacaacctgtctaaaacacttttcttattaggcgtcaaagccgtattttcagggattcgcccggatgtggcccaaacatcgattcaattggggcttgattttagtgaatatgaaacgtatggcacgctgaagcaggcattagaaaacatgggtgtccgctgtattgttgaggaattggaagaaaacaaatagggagtttctaggcatatgatcgtccgtcaccgggtgatcatatgcctttttgatttgaacagaaatcaccattgatttatcgaaaaaaacataatattataattcttataagaatactgtgaattaaaacctattcaacaggggggaaggtcttttggtttcaaaattaacgattgatccggaagtgattgaaaaaattatcagctcgctggaaacactcgatttcggcaccgttcagattacggttcatgattctcaggttacccaaattgagaaaatagaaaagcaccgtttttcgctgaaaaggaaagaatcaaaatgataatgtaaagggcgtttgttttcattaaattctccttaaaacatatacatatttcatccaatttttatataatagacctttaagatcattttttaggaggatttttgacatgcaagctacggttcacgagagtaagcaatcgatcatgcaacgcattttgacagtctttgtcttcactttgctgatcgcgactgtcggcctttttatcggccaatttgttcctgtcgctttgatgctgccgctttctattcttgaagtggcgatgattattctggccttctggatgcgcagaagaaaagcggtcgggtatgcgtttgtatatacattcgcgttcgtttccggcattaccttatttccgatcgtcagccattacgcttccatcgccggcgcctatgtcgtgctcgaagcctttggttctacatttgtcatttttgccgtcttaggcacaatcggcgcaaaaatgaagaaggatttatccttcctgtggtcgtttctgctggttgcggtgctcgcactcgcagtggtagggattttcaacattttcagcccgttaaactcagcggcgatgatggcgtattccgtgatcggaaccatcgtcttttccctttacattttgtatgatttgaaccaaatcaaacaccgccacattacggaagacttgattcccgttatggcgttatcgctgtaccttgactttatcaacttattcatcaacctgctccgcttcttcggcattttgagcagtgatgattaatgaaaaagcgcctgtctttggataggcgctttttgctatacatcaaaaaggcaggtggagtattgatgaaaaaacaaatgggcgcatatgcatctctggcagctgctatggcaatcgtcggcagctctgtcgttgtcggcaagctgatggtcgaacggattccggtctttctttcctccggattgcggtttttgatcgcttctgtcgtattgctcacgctgctgttttgcattgaaaaagggtttccggctttgacgaaaaaagatgtgttcgtattgctggtgcaatcattcacaggcgtgtttttgttcagtatttgcctgctgtatggggttcaatatactacgggaacggaaagcgtcattttgacaagcacaacccccatggtgatcggtattttatcctttttcctgcttagagaaaaaattgagaaaaagacgctgatcggcattttgctggcggtttgcggcgtaatggcgattaatttgtttggagcggggagccaagacgggacgccgcacgccttattcgggaacatgctgatcattgctgcagtcattggcgaagcgttgtttacatttatggccaagctgctatctccgcatgtttcggcactggcgatttcgaccttcgtatcactcttcggtttcctgttttttctcccgtttgctttgtttgaggcctcttcatttgatttcagcgtgccgactgttttggattggtcgtatgtgctgtattacgcgctttttgtcactgttttggcgttttacttatggtatagcggggtgacgaaggtgccggctggggtgtctggcattttcacatcctttcttccggtctctgctgtcatgttgtcaggcgtgctattgaaggagccgtttgagcttgtgcacattgcatgtgtcatcggcggcatatttgtgacggccataaagaaaaaacagccaatgcgtatccagctgcagaaagacgctgtagcctgtcctggtcggacgggtttttttagtctttaaatacgctcagcctttcaaaaagatcaccaagcatcttcacgaacatgtctttttcctcgtcgctgtagttttccatgacagcggatattttgctgaaatggccgggcagaaattgctcaaggcgtgctttgccttccgttgtcagttcaatgctgatttttcgtttatcctctgtgtgatgcctgcggctgacaaaaccgtctctcgccagcccgtccagcaggcctgtaattgttgctttcgtgacatttgaccgcttggcaagctctgtcggacttaacctatgatccttggcatcaaagagcagcatcaggattttgaattttccttctgaaagccctcggccagcaaagtaatgctccatcacatgattcattttttttgaaatatcaaatagagataaaaacaattcaagagagccggcgtcaatattggcatacgtttcggcgtgctctgttatatgcttatatttcggtaaatgttttaattccatcgcaagtagctcccgtacattcgttgtgagacgattataaaggagggaaaaccataacgcaacttggcttggagatgattgacagcttttcttgggacatagtaaggtaatatagttaggcgcctaactaatacatatagagctgaaaaggtggttatttatatgaaacatatgttaatagcaggaggcggaatcggcggcttgtcagcggctatttctctccgtaaggcagggttttccgtcaccttatgtgaagcggcttcagaaaaccgaaaaacaggtgcggggattcttcagccgcaaaacgcactggcggtgttgaaagaactgggcgtattcgaagagtgctgtaagcacggctttcaaacagaatggtttaaaacgtttgatgaacaggggaatttgctgtttcaagtcagtgaatcctttttagacgattcacttccgggacgcaataatatcctgcgcaaaacgttaaatgacattctcatgaagcatgccgaggcggcgggtgtagacatcaagtgggggaaaaagattgtcgcctatgaagaaacagctgaatcggtcactgccgtatatgaagatggggaaaagatgcaggctgacattctggcgggctttgacggcattcactctgctattcgcgatataatgctgcaaaaggagacggaaaaagagcatctcggcatgggagcgtggcgcttttatatcgaacttcctgactttacatttaaggacgcaacattcatgtatagaagcggagacacacaaatcggggtggtgccattggcggaacacgctggctatgtcttcgtcctccagccttgcacgagcgattactgggatgaggaagatacccggtttgatagagtaaaagagattctttctggttttcgggggctggattttgtcacaaagcacatgtcaaaacagcatcctgtcatctttaacaaactggagcaggtcgccgtgcaggagccatggcacaaaggccgcgttgtcatcggaggagacgctgcccacgccggcgcgccgaccctggcgcaaggagcggcaatggcgatcgaggatgccatcgtcctcgccgaagaactccaaaaccacgccgaccacgaaacagcattacaggcgtactacaaaagaagagccccacgagcgctcaaagtccagaacctatcatcggaaatcgtccgccgcgggctgaaaggagagccgggagcggaagaactgattggggagtgctatgcggtgttgagggaagggtattaaataggaaaagtccagaaagtgatttctggacttttttgtttagaaagacacaagtgtttaactaaattatctagaaattgataacaataaatgatgtaaaatcatccggtatttggtaaaattaagtcaaaaaatataagtttctgttagaatatcattatgtaaaataggggacattatggaaaagtggataggtaaacgccctacaataggtcaaaaaaccttagtaacaaagtatgaaagattattacaagaagcagaaatcgcaaccttatcgtcgcaggaaagcgttctaaagattatcgaagctgaatgtgataaaaaaagtggtagagaattaaaagggatattagcacttactacacaatccattttctttgtttctaagcacgaacagatgacttatgaatattcacaaattaatgatattgaagtaaggactaatggaaaagataaaaatagttggagtttaagccttaaaataggccgtaaaaaacgtacattcgatgatattaagaaaaacgatgatagccaagaatttatagagattttagaatacataataactaatcaatcaaaagaaattctaacgacagttacacatgattttgattattttttacatgctgaaaaattaaatgatttacaaaatcgaaatgttaaaattacttcatttctaatgaagagggacaatctaaatctgtcgaaaaatggtgaacgattattgcgtgaaaagcataaaggtgcttccttgatagcggaaggcttttttcaagaggatagacaaagtaagggtaattttattgtactcgacaatcaagtggtgtacttatatgaatttaataataaagaaagaaaagccaaactattaaataagtgggattttaaatatttttctcatgcggttattgatcgatttgcaataaaaacagttatcaatgttacggagacaggaaaaagtttaattataaatctatctggcaaggaatttgtttctattttaaatgatgcaaatattcccctacatcagaagaagaggaaatggtaccaaaaaatcctagggttccgaagtggtaagtggtggaagagagctattgcttcattggtttacctgctgatattactgttaacctttaacgcattttttggtgaaaacaataaagaagctagctctgtaaaatcaagtgataaaacagctgtttcaaagaccgaacaaaaggaagaacagacagaaaatcaaagcaaacaggaaggtaatgaacaacaagataataagagtaagaaagaagaaaaagcaaaaaagcaagcagaagagaaacgtaagcaagaggaagaagcgcgattagcagaagaaaaacgcaagcaagaggaagaagcgcgattagcagaagaaaaacgcaagcaagaggaagaagcacgactagcacaagaaaagcgcaagcaagaggaagaagcgcgactagcacaagaaaagcgtaagcaagagaaagagatacaacaagcagaggcacaagaacaacagacgaatgtctattacaaaaattgtaccgtagcacggcaagctggtgttgcacctatccattctggtgaaccgggatatgctaaacatcttgaccgtgatggtgatggaattgcttgtgatcgctaattcatatatggttatctaaagaaagagagaatactgaaatattctctcttttattattttcaacaaacgttaatcgtcatttatatttttcccttttatccgctcaatcacctcatgcagtccctcaggcttataaaactccaccggtgaactgcctttctcaaacgaaatcgtctcggcttcaatcagcgcgacatagcgcccgtttacttttgcgagatgaatagaatcgccaaaatccgctagcaatcccttaatctctgtttctccgactttcattttcagctgggcctctggcgtgtgctcgatgatttgggcggaggcttcgatgacttgatgggtgtcgaggcgctcttggatttcccgcttttcgcttgcttcccaaatttcaatgtcgtgctcgaactgcttgagctcttcgctgttgtcttcaaatgtctcgtagacgtgctcctgtaccatgttcatgacctgatttttcatgatttccggcatcgattcgccgtactcgacgaatttcagaaagtcctcaaaatagcgggcgtgcgaggcctgatggatttttagctcaccttcttcgaccattccttcctctggcatgtacgggtattggatgcttttcatgttttttgtcgtgatcgccatttcgacttttttaatgagagaagacgcgtcagagatgcgggcgaccttcggctcaaagtcacatttcataatgaagacaaatgactcgtcaaagtattttctcggcacggccgaagcgacgagaaacacaccgccgcggaccgcgcttgtgtcgaggtacgtgcggacgaactgctcactcagctcattgaagtcttcttttgtttccgccagacgcgcacggttgaacatgttgtagtttgggttggaatcaagctcgtggccgggctcgacgataaaatggccgattttcgtcggcacctgctcggactgcggatggcggtctgctttccgtttgacgatttttttcagttccccgtcgagaaagtccttcagctcgctttcttcaaattcgcccgtatcaagggtctggaagtgcttgaactgcttgttcgcctgctcatctttgccttccacctgtatgacataaaaggataaaaaccgaatttcaaaatccatatataaactcaccttattcgcgtattgtacagcttctcaagtatagaaaaaacagcaatcatgcgtcaattgggagaacggaataatcatgaccacgaaagggaaatgtagtcaaatagaaggcatctcatacggaaaggaatggttcgatgaaggaaacaagcccgattcctcagccgaagacgtttgggccgctcggcaatttgcctttaatcgataaagacaagccgacactttcgctgatcaaactggcggaagaacagggcccgatttttcaaattcatacacccgtgggcacgaccattgtagtgtccggccacgaattggtgaaagaggtttgtgatgaagaacggtttgataaaagcattgaaggcgccttggagaaggtccgcgcgttttccggtgatggattgtttacgagctggacgcatgagcctaactggagaaaagcgcacaacattctgatgccgacgttcagccagcgggccatgaaggactatcatgaaaaaatggtcgatatcgctgttcagcttattcaaaaatgggccaggcttaatccgaatgaagcagttgatgtcccgggggatatgacgaggctgacgcttgacaccattgggctatgcgggtttaactaccgctttaacagttactacagagaaacgccccacccgtttatcaacagcatggtgcgggcgcttgatgaagcgatgcatcaaatgcagcggcttgatgttcaagataagcttatggtcagaacaaagcggcaattccgccatgatattcaaacgatgttttctttagtcgacagcattattgcagagcgcagggcgaatggagaccaggatgaaaaagatttgcttgcccgcatgctgaatgtggaagatccggaaacgggtgaaaagctcgacgacgaaaatatccgctttcaaattattacgtttttgattgccggccatgaaacaacgagcggcctgctttcctttgcgacctactttttattgaagcaccctgacaaactgaaaaaggcgtatgaagaggtcgatcgggtgctgacagatgcagcgccgacctataaacaagtgctggagcttaaatacatacggatgattttaaatgaatcactgcgcttatggccgacagctccggctttcagcctttatccaaaagaagacacagtcattggcggaaaatttccgatcacgacgaatgacagaatttctgtgctgattccgcagcttcatcgtgatcgagacgcttggggaaaggacgcagaagaattccggccggaacggtttgagcatcaggaccaagtgcctcatcatgcgtacaaaccattcggaaatggacaacgggcctgtatcggcatgcagtttgcccttcatgaagccacacttgtgttaggcatgattctaaaatatttcacattgattgatcatgagaattatgagcttgatatcaaacaaaccttaacacttaagccgggcgattttcacattagggttcaaagccgtcatcaggaagccattcatgcggacgctcaggcagatgaaaaagccgcgccttatgagcaaaaggagaaaacggaagcaaagggcgcatcggtcatcggtcttaacaaccgcccgcttctcgtgctgtacggctcagatactggcactgcagaaggcgtcgcccgggagcttgctgatactgccagtcttcacggcgtaaggacagagacagcacctctgaacgaccggattggaaagctgccgaaagagggagcggttgtcattgtgacctcgtcttataatggaaaaccgccaagcaatgccggacagttcgtgcagtggcttcaagaaatcaaaccgggtgagcttgagggcgtccattacgcggtatttggctgcggcgaccacaactgggcgagcacgtatcaatacgtgccgagattcattgatgagcagcttgcagaaaaaggcgcgactcggttttctgggcgcggggaaggagatgtcagcggtgattttgaagggcagtttgacgagtggaaaaaaagcatgtgggcggacgccatcaaagcattcggacttgagcttaatgaaaacgctgataaggaacgaagcacgctgagccttcagtttgtcagagggctgggcgagtctccgctcgctagatcgtacgaagcttctcacgcatccattgccgaaaatcgtgaactccagtccgcagacagcgatcgaagcactcgccatatcgaaattgcattgccgccggatgttgaatatcaagagggcgaccatcttggcgtattgccaaaaaacagccaaaccaatgtcagccggattctccacagattcggcctgaagggaaccgaccaagtgacattgtcggcaagcggccgcagtgcggggcatctgccattgggccgtcctgtcagcctgcatgatcttctcagctacagcgtcgaggtgcaggaagcagccacaagagcgcaaatacgtgaactggcggcatttacagagtgtccgccgcataggcgcgaattagaagaactgtcagcagagggtgtttatcaggagcaaatattgaaaaaacgaatttccatgctggatctgcttgaaaagtatgaagcgtgcgacatgccgtttgaacgatttttagagcttttacggccgttaaaaccgagatattattcaatttcaagctctccaagagtgaatccgcggcaagcatcgatcacagtcggtgtcgtgcgcggccctgcgtggagcggccgtggcgaatacaggggcgtggcttcaaatgatttagctgagcgccaagccggagatgatctcgtgatgtttgtccgcacaccggaatcccggtttcagcttccagaagaccctgaaacgccaatcattatggtcggaccaggcacaggagtcgcgccattccgcggtttccttcaagcccgcgaagttttaaagcgggaggggaaaacgctcggtgaagctcatctctattttggatgcagaaacgatcgtgattttatataccgcgatgagcttgagcattttaaaagagacggaattgtcactgtccacacagccttttcccgcaaagaaggcatgccgaaaacgtatgtccagcatgtcatggctgaccatgcagaaacgttaatatcgatccttgaccacggaggcaggctttatgtatgcggtgacggcagcaaaatggccccggatgtggaggcggcactgcaaaaggcgtatcagtctgttcatggcaccggggagcaagaagcgcaaaactggctgagacatctgcaggataccggtatgtacgctaaggatgtctgggcagggatatagataaagaagactggagacatccagtcttttttgccctttagaaaaaatagtgatcgcgctaaacattgatgcatacaataacttcagtccgccggaagggcgggctgtctgcaaaacctatttttcgtttttgctagtttatgttattcttatactcggtatctatttcttttttcaaaggcacacatgacaaaagaaatcctttttttatttccgagaaaaaaatgtgaaacgaaatgaaggtttctttcgtccagtgattggtttccaaatggttgtaataaaaatgatatggtgcgaaacataaatattccggcttgccgcggtgtatttcttgttgtgtgatgccttgattttgtttggaaagaaggaattggaaggcaggatataaagagcaggtaaatatgaatgaagaacttaaagtgtttaagaaagtagaggttgccatgaagaaacttttttcttacaaacttagcttttttgtgctggctgttatactgttttgggcaaaaacgtatttatcctacaagactgagtttaatcttggggtaaaaggcacaactcaggagatcctcctgatatttaacccattctcaagcgccgtcttctttttaggactggctttgctggcgaaagggcgtaaatcagccattattatgctgattatcgatttcttgatgacatttgtgttatatgcaaatattttattctatcgtttctttgacgatttcttgacgttcccgaacattaaacagtccggaaacgttggaaacatgggagacgggattttcagtatcatggccggtcatgatattttctatttcttagatattatcattttgattgcggtattgatctggagacctgaattaaaagaatacaaaatgaaaaaacgctttgcgtctttagtgatcctttctgggatcgcactgtttttcatcaacctgcactatgcggaaaaagaccgtccgcagctgttgacaagaacgtttgaccgcaattatattgtgaaatatttaggtttatacaactacaccatttatgacggtgtacagacggctcaaacagaaacgcaacgggcctatgcaagcagcgatgatttaacaagcgtcgagaattacacgacgtctcattatgcgaaaccgaacgccgagtacttcggctctgccaaaggcaaaaatatcattaaaattcacctcgaaagcttccagtcattcctgattgactacaagctaaacggtgaagaggtgacgcctttcttaaataaacttgcgcacggcggggaagatgtgacgtattttgataacttcttccatcagacaggccagggaaaaacatctgatgccgagctgacaatggataactcgatcttcggtcttcctgaaggctccgcgtttgtgacgaaaggcgaaaacacctaccagtcgcttcctgcgattttagaccagaaggaaggctatacaagcgccgtcctgcatggtgattacaaatcgttctggaaccgtgaccagatttacaaacatatcggatatgacaagttcttcgacgcaagcacgtatgatatgtcagatgaaaatgtgattaatatggggcttaaggataagccgttctttacagaatcgattccaaagcttgaatctcttaaacagccattttatgcgcatttgattacattgacaaaccattatccgtttaaccttgatgaaaaagacgcgtctcttaaaaaagcgacaacaggcgataacacagttgacagctacttccagacagcgcgttaccttgacgaagcgcttgagcaattcttcaaggagctgaaggaagccggcctgtatgacaactcagtcatcatgatttacggtgaccataacggtatttctgaaaaccataaccgagcgatgaaagagattcttggaaaagagatcacagattatcaaaacgcacagaaccagcgtgtgccgctgatgatccgcgttcctggcaaaaaaggcggagtgaaccatacgtatggcggcgaaattgacgtcatgccgacacttctgcacttagaaggaattgattctcagaaatacatcaactttggtactgacttattctctaaagaccacgacgatacagtggcattcagaaacggagacttcgtaacgccgaagtacacatcagtcgacaatgtcatttatgatacgaagactggtgaaaaactgaaagcgaatgaagaaacgaagaatctgaaaacaagagtgaaccagcagctgagcctttcagacagtgtcctgtacaaagacttgctgaggttccataaactaaatgatttcaaagccgttgatccgtctgactatcattacggcaaggagaaagaaatcaaataagatgaaaaagagccttgagcgggcgcattgccttcgctcaaggctctttttttggttatacaaccaacttgaaaaaatagattccatttggtcaccaaggctggctttctctcatatcattacagtagattttgaaaccggtattgaaatcggacaaattatcggggaaatgccttgatagattgtgaagatgtaccaggtttcgaactcaatattcatagagatgaggggtagagatgaaagcggtcattctctgcggcggaaaaggaacgagaatgagtgaagtcacgaatgacattcctaaaccgctcgccatgataggcggcaaaccgattctatggcatattatgaaaatttatcagtactacggagtaaacgagtttattctgctgttgggctataaaggagaaaaaatcaaggaatactttctcgactatgaatggaagcacaacagcctgacactcgacagctctacgggagaggtacagatcctggggcagcctgaaacgtggaaaattacgtttttggagactggggaagatacgctgacagccggaagaatcttgcaggcgaaagactatatcggtgatgaaacatttctgctcacctatggggacgggctggccaatatcaatcttttccatctcatcagctatcatcagacaaaaggtgctgccgcgactgtcaccggcattgacaaagtctcgcagtttggcaccttgacggttgaggacggcatggcgaaaacattttctgagaagacatcaagtgacggaatcatcaacggcggattcttcgttctcagtccaaaggttttcgagtatttgccgaaggacggggacgcgatgttcgaagatgaaccgctgaagaaccttgccaaagacggggagcttgctgtgtaccgccattatggattttggacggccatcgatacgtataaaaatctcttagaagtcaacaaaatgtggaatcaaggacaacaagtatggaaggtatggtgaatcgatttgagtttctggaaaaataaaaacgtatttgtcacgggatgcacaggtcttttaggaagctatttggtgaaagagctgatcgatcagggcgcaaatgttacggggcttgtcagagatcatgtgcctcaatccaatctttatcagggagaacatatcaagaaaatgaacatcgtgcggggctctcttgaggacttggctgtgattgaacgcgcgcttggcgagtatgagatcgacactgtctttcatctcgctgcacaagcgattgtcggcgtggcaaaccgcaacccgatttctacctttgaagcgaatatcctcggcacctggaatattctcgaagcctgccgcaagcatccgttaattaagcgggtcattgtcgcttcaagtgataaagcttacggcgatcaagaaaaccttccatacgatgaaaatatgccgctgcaaggcaagcacccgtacgacgtctcaaaaagctgtgcagatctgatcagccacacctattttcacacgtacgggcttccggtctgcattacgcgctgtggaaacttatacggcggcggagatttgaacttcaatcgcatcattcctcagacgattcagcttgtgctgaacggggaagcgccggaaatccgaagcgacggcacatttgtacgggactatttctatattgaagacgccgttcaggcttatctgcttcttgcagaaaaaatggaagaaaacaatcttgccggagaggcctttaacttcagcaatgagatccagctgaccgtacttgaactggtagagaaaatattaaagaaaatgaacagtaatctgaaacctaaggtgctgaatcagggaagcaatgaaatcaaacatcaatatttatccgcggaaaaagcaagaaagctgctgaattggacaccggcctacaccattgatgagggacttgaaaaaacgattgagtggtatacggaattcttcaaaaagtaatgtgaaacgaggtgaacaagactgtgaccagcgcgtattgcaccgttttatcaaaaggaagattatatcaggcagtcgctttgtttaagtcgttagagctagttgatcaagacagtcccatttttatactttgcatggatgaagatacgcaccgcgtgttacagaagctgaagatgaagcagctgaaccttgtgccggtggccgctcttgaaaatgaattgctattgaagctgaaggaaactagagatcaaagtgagtattgctggacgatgaagccgatctttctgcaagctgtgctgaacagcaatcccgggctggagcgtgtgacgtatattgacggggatctctttttctatgcagatccatcgccgatttttgaaaaccagccggactgctcggtgctgctttcacggggggatattgtaatcccttcttttgagaaagagcagattgacatgctgcagcgtcttttaggcagatataattccgggtttatcagcttcaagcatgatgatgcaggcacggattgcttggagtggtggaaggaacgctgtcttgaggaatgcaaaaatgcaccgggtgaaggaaaattcggtgatcagggctatttggattatatgtctgagctgtttccgaatgtgtgtgacattacaacacccggcgtgaacatcgggcattggaattatgggcagcatacgttttcctggaaagatggccggatcgtgctggaggatggcagtccgctgatcttttatcatttcagcggataccgaatcgtcagcatcaatgaaatcaaacagattcatgaaacaacccgcacagatctgccgtttgtgcatgaactgtatcaagagacactgccgcatatcattcagcacatgaaaacgttagaccctgaatttaacggttttgcttcaaaagatgacaacaaataaatgagtaaatacaggaagtgaaaatgaagtgaaagcaagcgttattattcctgcatataattcaaaggagcgtctttacaacagccttctgtcattaaaccagcaggagtgcgatgaagaattcgaagtcattgtagcggacaatggctctgaggacgggacgctctcgatgcttgagtcatttcaagctgattttccgctgatctttacacggattaaagaaaacaggggcattgcgtacggacgaaatcaggcgcttcgcaatgccagaggagacatcctgattttccatgacagcgatatgcttgcggcaaaggaccttgtggcaaaacatattaaagcccatgagaacgaagagaatctcgtcgtgtgcgggttgttttggaaacggatctacagtttttattatgaacggtttgaagaagaacataaggaacagctcgcaaagctcacaggtgaaatgccgaagaaagacaaacaaaagctgctggaggaggcggacatcaaaaacggaagctttcttgataaaagctttgacctcgataccgactttatagacgtgctcaagaagattttagatgagtacggcgatgacttgaaaggctatcatatgccatggcgcttttttatcacgaataattcctctgtgaaacgcaagcatgtggttgacctcggtttatttgacgaaggcattgtgcggtacgggtttgaggattatgacctcgggatcaggcttcatcaggccggattgaccttcaggcttcgccgcgatattgtcagtgttcatcaggaacatccaagcaattgtaagtctgtagatgatattcgggccaacattgcctatatgtgcgataaatacaataacatccgctccttagacgttcatctcgcttttaacgggccgttcccgcctgacatgacgaacagaatcatgactgatattcaaaagctgctggagtctcagaaatatgatatgctgctgaatctgtttcttgagcttctgcatgttgttaaagagcgcaacattgatccggattggcgaaagaaagccccaagggtgacggcgaaaagctttgatttacaaactgtccgcaagcttctgccaaaagcgaagaaaaagctaggcgtgaacgattttgccaacgcactgtatgcgcttgtcaacgatttgctgcacgtggatcttagatcattggatgtggtataagtgagtacatttcatttttcaacgatagtgtcaaggacacatatctttaagctcatgcctatgattcattctctccatgagcattgcgatgattttcatttatatgtgctgtgtgtcgaccagaaagcgtatgaattgcttcagcacgtgccatgggagcatgtaacctttgtgcagctgcatgaaatggaagacccggagctgttgaaagcgaaaagcaacagaacgtttcatgaatattgctggacgttaaagcccgcctttttgtttcatgtgatgagcaagtgggatgacgctgagtactttgcccatatggatacggatctatttttcttttctgatccggcgcgtatttttgcagaaaacccaacggcgtctctgtatttgactgatcatcgtaattcgccgcgcttcatgtcctactacgaccgaaccggacgctttaatacaggctttgtcggtgccggtaatacaaaggaagcatatgaagcggtgtggcagtggagacaggactgtattgaatattgcacggtcgaaatggatacggaacgaaagacatatggtgatcaaaggtatgtggagaaatggccggcgcagtttaaaggtgttcatgttgtcaaatcaataggagccaatacagcgctttggaatatcgaaaactataaggtcgggcaaaaggacggccgcgtgtatatagatgaaacgccgctgatcttctatcatttctctgggtttacactggtgacagaaaaagagtttaatctttgctggtactaccggattgaagacgaagcgacaattgagatgatttatatgccgtatatattaaatctgaaaagatggattgatgaaatacagtcggcgtttccggactttgcggatggctttatcccgaagcatgcagtgcctgacactcattttatccagctggattaaaaaacccctgccgcctggcaggggttttttcagctatgccattctctcagcttctggtcactcggcaataggaaggcaaggatgccgagaacagggagaaaggcaatggcgatcatcgtcggggtcagtcccgcggcgtcaatcagagcgcccagcgccacagcgccgattgcgcccatcccgaaggcaagcccgacggttaaaccggacattgtgccgatttttccaggaactagctcctgtgcgtagacgaccgttacagaaaagctcgacatcagaaccaagccaatcaatgcgagcacgccataggcgagaaccgggccggcaaatggcagcacaatcgccagaggcgccgagcataacagcgaaccgaggataacgaagcgttttccaaaacggtctgcaagcgggccgccgagaaacgtgccgattgcgccgaacagcaagaagacaaaaatatagctttgtgcctgctgaatgcttacgtgataggtatccatcgcgtaaaacgtgtaaaagttaccgatcgcactcgtataccaagaacgagcaaaaatgagaaatataataataataagagcagatacaacagatttggtgatggccgtgttttcagccgttttcttttgtttgcctgatttctgggcaaggctgccgagacgtgaggcgtaccatttcgcaatatacatgagaaacataacagcaagcgcggcgacaagcgtgaaccaaacagcgccgaattgcccgagcggtacaaggatcagcgcggtgatcagcggcgccatcgcctggcctgagtttccgcccacctgataaatcgactgggcgagcccgcgttttgtgccggcggccatatacgccacacgggagccctccggatggaaaatggccgagcctaatccaatgaaaaacacacagcataagatcgttatgaatgacggggcaaatgcaaggcctaaaatgccaagcatgctggcggtcaaaccgactggcagcgcatacggccgcggccgtttatcggtataccagccgacaacaggctgcatgacggatgacaccatgtttaatgtgaaagcgatgatgccaagctgtgtaaacgtcaggctcatggagcgttccaaaatagggaacatggccggaatcacagcctgaagcgaatcgttgagcatatggcaaattccgataataatcaaaatcggatacaccgtggtgcctggtttttgaactgttttttcttttaccggggcggcgatagccaattgagtctcctccttacatatataaccaaagcataccaccatattattcataaggtgaagaatttatcaagaggaaaaaagattcttatgaaagaaataccgtcagcctgattaggagctgacggtattttcgatattcaaaatgtgatatagctcttcaagcttacgaatctcataggttggtatgatctctggcacattcggcttcatgtcagggttcatccaacaagtgtcaagtccggcgagctgtccgcctttgatatcagcagtcagtgaatccccaatgattaatgtgtgctctgctgaaaattgaggaatccgttcaaatacgtaatcgaaatattccttcatcggcttttggaagcctgtgtcttcagaaacgaaaatgtccttgaagaatggaaataatcctgaatcacggagacgcttatattgtgtgtgagacacgccgtttgtcacgatgtacaaatcaaactgttgctgcagatttgagatgagatcaaatgcaccgtcaataagctgatgtccttcttcaagaaagcggcggtatttttgctcaagtttggttccgtcagtctcatagccgtattctttaagcaaagcggagaaacgtgtgtttacgacttcatcccgtgtcatcttaccttcttcaaaggctctccagagaccttgattgatggttttatactgcgccttcatgtcatttgttaaaggaatgttctgatcttcaaacagcaaacgcagggctaaagcttctgccgcttgaaaatcaaggatggtatcatctacatcaaataataaagtgcggtatcgtttcatctgtgtgtctccctttctcatatgtattcaaagtatagcacataaaaaaaggaaaaagccggcgggtgaggcaccgccggctgaaaagagattatttgtttaataagctgtgttttctcgaatataggaagtaaaccagcgttccgacagcgatccagatgacaaatgaaagccatgtgacgccgggaaggctgtacatgaaccaaaggcagatgcctgcgctgataatcggcacaaccggaacgaacggcactctgaaggacgccttgatttcaggatgtttctttcttagcacaatgacagcaatagatatgactgtaaacgcggcaagtgttcccatgttcaccaggtgggccagcgttccgaggttaataaagccggcgattcccgctgcaacgatcccggtcagccatgtgttgcggaacggggttttaaatgacggatgaacctttgcgaacaatccaggcagaaggccgtctctgctcatggcaaatgtcaaacgaacctgagcgtacagcaaagcgagcatcaccgtcgtaatcccgataatcgcaccgacagaaataattccggcaacagcgtcctgtccgacgaatttcagagcaaaggatacaggatctccgacattcaatttggcataaggcatcatgcctgtcagcacaagcgataccgcgatgtacagaaccgtgcagacggctagagctgaaataatgccgacgggcatgtttttttgcggatttttcacttcctctgaagcgttagaaaccgcgtcaaacccaaggtacgcgaagaatacagtggcagcgctaagtatgacgcctttcatcccgaatggcataaaaggagaccagttatccggtttcacatagccgaggccgacaataatgaacaataatatgatcgcgattttcatcagtacgatgacgttgttaaagcgtgtgctttccttgacgcctctgctgacaatcgcagtgatgaggagtatgatcaccgcagccggaaggttaaatacggcgcccgccgtgcttcccggcgctcctgtaagtgcagccggaatatgaagattgaagccggcaagcagtgattgaaagtatgaagaccagccggtggcaaccgccgacagtgcaatgacatattcaagcatgagatcccatccgatcaaaaaggcgagcagctctccaagtgtcacgtatgagtatgagtacacgcttcccgaaatcggaatggaagacgaaaactcagcataacagaaagcagccagcgcacaggcgagccccgctaaaataaacgatatgatgagggcgggacctgcaccggtcgctgccactgttcctgtaatgacaaaaatccctgtaccgatgacacaaccgataccgagcaaggttaaatcaaatgcgcttaacgtacgggcaaggctttttgacttgctctgcgcactcaatgtttcaatcggtttttttctaaataatgaactcatcaaaagttcctcctagaaatattcaaaatattctaatcattatatgcagttcttgttgtattatattgtcgaaatttgacgcagtcaataaaatatttttctgctttaaatgatagaagcaaaacagcgttgtcgtatcataggatagtaatttttactaatcgtatattcaattttatgcaagatgaaccgatagaaaaaatagattcgcccatattttgatttgcggttataaaggagatgctgaccatgtttcaatatgaagagttgaataaacagtttatcggcgggaaatggcaggagggcagcagcccaaatgtattggaaaacaaaaatccttatactcaaaaaacattcacaacattccgtaaagcgactgctgacgatgtagatgaagcgtatcgggcagcggcgctggcaaagaaaaaatgggatgcggtcaacccgtttgagaaaagaaccattttagaaaaagccgtcacgtatattgaagaaaatgaagaagccattatttatttgattatggaggagctaggcggtacaaggctcaaagcggcttttgaaatcggacttgtcaaaaacatcatgaaggaagcggcaacgttcccaatccgcatggaggggaaaattcttccgtccacaatagatggcaaggaaaacagattatatcgcgtgccggcaggcgttgtcggtgtcatcagcccgtttaacttcccattctttttatctatgaaatcagtggcgcctgcactcggagccggcaatggcgttgtgctaaagccgcatgaggaaacgccgatttgcggcggaacattgatcgcgaaaatttttgagaacgcgggaattccagcggggctgctgaatgttgttgtcacagacattgctgaaatcggcgacagcttcgttgagcatccagtgccgcggatcatctcatttaccggttctacgaaagtcggcagctacatcggacagcttgcgatgaagcattttaaaaagccgcttcttgagcttggcgggaacagcgccttcatcgtacttgaggatgcagatatagaatatgcggtcaatgcggcggtgttcagccgatttacacatcaaggacagatttgcatgtcagccaaccgcgtgcttgttcattcttctatttatgacaagttccttgagctgtaccaggcaaaagtggaatcgctgaaagtcggcgacccaatggaccctgatacgattatcgggccattaatcaacagcagacagacggacgggctgatgaagactgtagagcaagcaattgaagaaggcgctgtaccagtgaagcttggcggatttaacgggacgatcgtggaaccgacgatcttaaaagacgtcaaaccgttcatgagcattgccaaggaagagctgttcggaccagtcgtctcctttatgaagtttgattcagaagacgaagcggtggatatcgcaaacgaaaccccgtttggcttgagcggtgccgtacatacgtcaaatcttgagcgcggcgtggcatttgcgaaacgcattgaaacaggcatgattcacgtcaatgacacgaccatcaatgatgaaccgaatgtagccttcggcggtgaaaagcaatcaggcctcggccgtttaaatggtgagtggagcctcgaagaatttacaacgctgaaatggatctcggtccagcacgaaaaacgcagcttcccttattaatgaaaaggagtgaatggaattgaccataaatacggaaaaagaaaccgcagatattctggacgcatttatcaaagtagccccttatttaaacagcctggttcaggatgatattacaatcggcatttatgatacggaaaaactgctcgtgaatataccggccaaaaccttttcgctgaacgtaaaagccggcgatccgctgcaggaaggggatatcatcacagatgccatccgaagcaatcagaagaagacgagcatggttccgaaagaattgttcggcttcccattgatcgcgcgtgccatcccgctgcacgacgagaatggaagagtcattggaggcgtcggcctcggaacgagccttgaggagtcgtcaaagctgcatgatgtcgcggaaagcttatcagctgtcgttgaacaaacagccgcggctatttccgacatttctgaatcaattaacgggttttcaactcaaatgtcgggcatttcctctcaggcgaaaaaagtaagcgaaagcgccggtgaaatcgccgatatttcagtaactgttaaaggcatctctgaccaaagcaatctgctcggcttgaacgccgcgatcgaagcggcaagagcaggggagtccggaaaaggcttctctgtcgtcgcagatgagatcagaaagctagcaacgcattcaaaagaaaatgtcggccaaattgaccagattacgaaaaaaatccacagcctgctgaaagggctggaggaatccattgagtcgattaaccagcatacagacggacaagccgctgctgttgaacaaatttccgccacaatgcaggagatttcaggaagcgcacagcatcttgcaaaaatggccgaaaaagcgcttgaggaagagtaaaagaccggggacaaatgtccccggtctttttctatcctgcatttccatgaaattcgtctgacgttttactagttttattccagcggctgatttaaaatgtacacatgaacttacgtgaggattgataggaaccatgagcatattaaaagcggaaaatctttataaaacatacggagataaaacattatttgaccatatctcctttcatattgaagagaatgagagaatcggattaatcgggccgaacggaacaggaaaatcaacgctgctgaaagtgattgccggcttggaatctatcgaagaaggagaaatcacgaaatccggaagcgtgcaggtcgaatttcttcatcaagacccggagctgcctgcggggcaaacagtgctggagcatatctattccggtgaatcggctgtgatgaaaaccttgcgtgaatatgaaaaagcgctgtatgaactggggaaagatcccgaaaatgaacagcgccagaaacacctgctggcagcacaagcgaaaatggacgcaaacaatgcatgggatgcaaacaccttggcaaaaaccgtattgtctaagctgggcgtcaacgacgtaacaaaaccggtcaatgagctctcaggcggccagaaaaaacgggtagccattgccaaaaacttaattcagcccgctgatctgctcattttggacgagccgacaaaccatttggataatgaaacgattgagtggcttgaagggtatttaagccaatatcccggcgccgtcatgctggtgacgcacgatagatatttcctaaaccgtgtcaccaaccgcatttatgagcttgaaagaggcagcctctacacgtacaaaggcaactatgaagtgtttttagaaaaacgcgcggaacgggaagcgcaggctgagcaaaaggaaacgaagcggcaaaacctgctgcgccgcgagctggcctggctcagacgaggagcgaaagcccgctccacaaaacaaaaggcgagaattgaccgggtagagtcgcttaaagagcagaaaggccctcagtcatcaggttcactcgattttgccattggctcgcaccgtctcggaaaacaggttattgaagcggagaacgtcatgatcgcttatgacggccgcatgctcgtcgaccgttttaatgaacttgtcataccaggtgaacggatcgggatcatcgggccgaacggcatcgggaaaacaacgctgttaaatgcccttgccggccgtcatacgccggacggaggcgatattacgatcggacagacggtcagaatcggctactatactcaggatcatagtgaaatgaacggtgagttaaaggtcattgactatataaaagaaacggcggaggtcgtaaaaacggcagatggcgatatgattacagctgaacaaatgctcgagcgtttcctcttcccgcgttcgatgcagcagacgtatatccgcaagctgtccggcggggaaaaacgccgtttatacttgcttcaggttctcatgcaggagccgaatgtcctgtttctcgatgagccgacgaacgatttggatactgaaacattaagcgttcttgaggattatattgaccagttccctggcgtcgtcatcaccgtatcccatgaccgctatttccttgaccgcgtcgtcgaccgtttgattgtatttgaaggaaatggcgtcatttcccgctttcaaggctcctatagcgactatatggaggagtcaaaagcgaaaaaagcggccccaaaactgacagctgaggaaaaaacggctgaagccgagccgaagaaaaaacggaaaaagctttcttacaaagaccagctggaatgggacggcatcgaagataaaattgcccagctggaagaaaagcatgagcagctcgaagctgacatcgccgcagcaggcagtgattttggcaaaatccaagagctgatggccgagcaggcgaaaactgctgaagagcttgaggctgcgatggaccgctggacagaattgtccctcatgatcgaagaactggaaagctaaaaagcgtggccgcagcaggccgcgctttttttcacataatggacaaaaacgaaccggcctgcttatgttaggataaaattgtgtgtcagcggcacatggaaaactaacggagatgatgaagtatgacatgggcgatcgtgatgttaattctcatgagtctggtgaaaatcgtattaacctgtcttcctacaggcgtcatagaatggctgctcggcaaatttgaagtgcacgccaagcttagtggcgaaaatgcgagtctctctctagatggaaaacgtctcgagggtacagagaagcagaaagtgattgatcaatttaacgaagctgtcttcctggagaaattttatatctatccaggtgatgaagagcgttatttacatccggcaaacggcggcacgccgctggtgatagatacaaaaaaaggaaaaaaagacgtgaagctgttcgtgtaccgctacgacgaccatatcgacgtcgtgaaacagtacaagaagaaagtgatcgcgtatcgagtgctttctgaaagccttcaaaaagagtctctgtcagtggcggggagtttagcttaaacaggaaagtgaaagacgggtgctgtatgctactcgtctttttattgttttttaaaccttaacgtttacgttaaggtttaaaaggtgtataatggtaacagaaacggcgaagggggatttaccttggaatggatgaagattgatcaagtggccaaaagaagcggactgacaaagcggaccatccggttttatgaagaaatcggcttgattccggcgccgaaacggacagacggcggcgtaaggctttattcagaggatgatatggaggagcttgagaaagtcatcagcacaaaagaggtgctcggtttttcccttcaggagcttcagcatttcatggaaaccagccgccagctagagttaaacaaagaggggtatttgttgtcactggatcctaaggaacggaaagaaaaactggaggaaattcaggaaaccctgaatcaccagctgagtttgattgatgagaaaatccgcacattccaaagctttaaagaacgcctgcaaggcatgaaaggcaaagcggaacgcgccattcaatcaatcgaatgaaaagtttgttaaacgctatttttgtagcgtttcttttaatggaataaagatggaggttaggtcaaatggataagacaacacaagtgaatcagaaaacgggtttgctcagccagccaaaagcggtatgggctgtcgcatttgcctgtgtgatttcctttatgggaatcgggctggtcgatccaattcttccggccattgccgcacaactacatgcttcacctagtgaagtatcactcttgtttacaagttatttgcttgtaaccggatttatgatgtttttctcaggagccatttccagccgcatcggcgcgaaatggacgttaattctcggacttatttttattattgtgtttgcggggcttggcggcagttcaagctcaattgctcagctagtcggctatcgcggcggctggggattaggtaatgctttgtttatttcaacagcgcttgcggttatcgtcggcgtgtcagtcggggcagcgcccaagcgattattttgtatgaagctgcgctcggtcttgggatttccgtcgggccgcttgcaggcggagagcttggaagcatttcatggcgcgcaccgttttttggggtatctgtcctgatgtttattgcgttaatcgcgatttctttcatgctgccgaaattgccgaaaccggcgaaacgcgtcggtgtgtttgatgcgatgaaggcgctcaaatataaaggtctgctgacgatggcggtatctgcgttcttatacaactttggattttttattttgcttgcttattctccgttcgtactggatttagatgaacacggtctcggatatgtcttctttggctggggtcttctgctggctgttacgtcagtctttactgcgccgctcgtgcacaaagcgctgggcacagtgcgttccttggttgttctctttatcgcctttgcagtcattctcatgatcatggggatctggacagagcatcagacattgattattacatgtatcgttgtcgctggtgctgtcctcggtatggtgaatacgatcatgacaaccgctgtgatgggttctgcgccggttgaacgttcaatcgcgtcttcagcctacagctcagtccgcttcatcggcggtgcgctcgctccgtggattgcgggaatgctgtcagagcacttcaccgcaagcacaccatatacagtaggcgggatcgtcgtttttgtcggcatgcttgtccttctcatgggacgtaaacatcttgccggaattaaggcgggtcattaaaaaggaatagttattcctgtcaagtaggcaggaataaaaaggttttaaacgacctgagtcctatatgtacatgacgggctcaggtcgtttaatttctattggaatcacgatattaaagtaccttttacacgtctgtaactattgctccctttcagtttccgggggcatcgttcaggatatttttaatcctgggcttccaatgttttctccgaaggcattccaatctttccaccacttataaaagccacctcttgagactttcatgacctcgcatattccccagcggccatctcttgtataatgggaacttcaggatttacctacaggtcttttctttggggatccttggcttacctcttctttcctctaaagcagcttttacccaacaaagcctatggaggtattgaattcctacgacgatgtttgtacctttctcttcttcattcaaaatctctgtgccaatctttctcttaaacgagatttcaccataaggttattcccttaaaaacattaaaagctttttaaatcaatctatctgaagaagggaattatatcactcgtgaggttctatttaatttttataacaagagaacgttctgggggtttaatgagtttatttaactattttttctcttgtatttttatatttatgggaaatatatattgagggagattacattttgtagtagaatactattggaaaaaggaggtgtaattaactgaaaaggtatatttttatttttatttccatattatccattataatattactatttttcattgatttaaatcaatcccaagggagtaaagtgctaagaaaaaagggcaagaaacaaaagattataagactcaacaagtcgagtcttggggattaaggctaattgggaagaatgaaaaaatagagaaaaaatccaacatatctatagccattcttgatagtggaatagattcaaatcatgaagatttaaaaggtgttgtaaagaaagaatataatgctcttgaacctagtaaaggtgttatcgaggataagtttggccacggaactgcagtagctggaatcatagcttctaatgataataagattggtacattaggaatagctccctatgcagatatttattcggtcaaagtattggatgataaaggacgtggtagtgtagagtctattgttaaggggattgaatggtcaatagataataatgtagatattgttaacattagtgttggattgaaaaaaagtgatcaaaaattaaaaagagttatagatgaggctaacgaaaagggagttattgtagtagctgctgctggaaataattatggattaaatgctgattatcctgcaagatatcaaaatgtaatttcagttggagctataaataaaaaaatgaaaagagcaaaatactctgcaaggggaaaaatagattttgttgctccaggtgaagatattcttacaacttctcctaaggataattatatcaatgttagtggaacatccatggcaactccttttgttagtggagttattgctaatataataatgcaagaaccagttaaatatagtaaaacaaagagccgctttacttccatttataaaactttaaaaaaatactcaacgccttatttatctgaaaagtcagatatgaaatctttggggaatggcttaattagtctaaaaaaggagacgaacaatgaaaaaatcaattaaatttatagcgatttcactaatattcgccataattgtatctattatccctgaaaaaaatgtagcgagtgcaggtgctgaaacaccagtagagattacaaatgaagacctacaaagagcattggtggaaaatggagatatagtggatccggattcagttgaaatagttaaaaataatgaagacacgattaaagctgaagtggacgtccaaacagatgatttcggaattgatcaagatttagatgggagtgactcagaatcactgattgatgaagatttagatgaaagtagttctgaaacagtaactgcagaagttgataaagaggacgcgacagctattgtaacatctgtggaaaaagatgaagatggaaaagatatcgaaaaaaaatatgaagttgatatcgaagaagctgatggcgatgatattgtggctactttcaaagaccttgataccaatcaagtttatgatgtaaatactaaagaagcacaagcgtctttcgcttttttagttccaattgctgttgtagttggtggcgctttagttgagcatttggttgctgcttctttggctatagttatagcgggtgtaacgtatactgttgctactaaagtaagaagcaaattaaagaaaaagaaaaagtactattattatgctgcgactctaaataagaataaaacaaatatgtatattggaccagcactatcgaaaaaacaagcagtttctagactaagaaagggagacgtatggtcagtttctaaaagcaaagcaaaaaatgttgcacaaactgcgggcggtggaagaaaacctgttggcccagaaattcataataagaaagatggtaaaataaagaagggtacttattattatcattaccatacatacaatagaaaaggcggacattcattctattgatatgggggtatgcggttgataattttttcgaaaacagataattaaacgatttgaaagtactaatattccattagctcttaatattaaacaagctagtcaagtcttaattgataaatataatgcaattgaatttaataaagaagaaatcgccgacttaaaaaagatcatatagttaattttaagaaaataataaaatgttttgctattcaagacgaagctttattaaaaagtttacgaagtaaaagagaagaatttgaagttcaggaaaccatctctgagtctcgccatgaaaatattcaaagaagtgagtacaataataataaggattacagaagagctttaatgtgggaatcaattcaaaatggtaaaagagtaaacaaaatttttgaaagtaaagatggtaactatattagtaattttacagtacaaggtaatgtagaaaaaattgagaaagaattagtgtttattagagggattcttgaaaaagaaaaaaataactaatcaaaaatttcaatattacttagatacactagttgacctaaaatatattttagtaaatagttgacaaggcattagttttttggcacatttattttgcacaatggattaatgtctattttatgaatagttgatgtcattaatttatattatagtattaaaacaggaaggaaaagagaaaaaatgactcaattttattacctagctgcaaaaaaaccattaaaaacaggtttttttggtcatacaaaagctacaactaataaaggtcatccagtaaggacagggcctgaggcagctggtatttatgttgaagaaatcggaaatgtttctaataatctcactttaccttatcaagtacaaattcatgaatatttaggcacttttgcaatggacaaaccagtacctacagagttagatttaaaatgtttagaaacgctctatcaatacatacacagcgtcatgaaaaacagcttttcggttgaatggttcaccgcatgggctgatgaggaagactttgagctgtctgccaaaagagagctgacacttgatgaattcacatctccattgcagctcattttaaaagacagagagctcctgagaatcgttcagaaaaaatggcagtaaaaaaacccgcccttcagcaggcgggtttttttataaattaaagcactttcgtcgtccaagactcgcagttccacgtttctgtcgcaatatccatataaaagtctggctcgtgggaaatgagcagaatggagcctttatattctttcagggcgcgcttgagctcttccttggcatcgacatccaagtggtttgtcggctcatcgagcaccagcaggtttgtttctgagttgattagcttgcacaatctgactttcgctttttcgcctccgcttaatacggagacgcggctttcgatatgctttgtcgtaagtccgcattttgccagagcggcacggatttcatactgcgtataagaagggaattcgctccatacttcttcgatgcacgtattgttgtttgtttccttgacctcttgctcgaaatagccggtatagatgtgctcaccgcgttcaacagagccttcgagcggctggatttcaccaagcaaacttttcagcaatgtcgtttttccgatcccattcgcgccgtaaagggcaattttttggccgcgctccatgcggaggttgagcggacgggacagcggggaatcgtaaccgatcacgagatccttcgtttcaaaaatcagcttgcctgacgttctcgccggcttaaagtggaattccggctttggcttttctgccgcaagctcgatcatatccatcttatcgagtttcttttggcgggacatcgccatgtttctcgtgctgacgcgcgctttgttgcgggcgacgaaatccttcagctccgcgacttcctgctgctgctttttataggccgcttcaagctgctgtttcttcacctcgtagacttccataaactgatggtagtcgccgacatagcgtgtcagctcttgattttcaacgtgataaatcaggttgatgacactattcaagaacggaatatcgtgggaaatcaggatgaacgcgttctcgtattcctgcaggtagcgtttcagccattcaatatgctgttcatcaagatagttggtcggctcatcgagaagcagaatttccggcttttcaaggagaagcttagcgagaaggacctttgtgcgctgtccgccgctcaaatcggtgacatctcgctctaatccgatatcgctcaaaccgagaccgcgggcaatttcctccaccttggaatcaatgacataaaaatcattgtttgtcagcgcgtcttgaatgacgccgacttcttcaagcagcttttcgagctcgtcgggatctgcttcacccattttgttgtaaatctcgttcatttcctcttccatcgcaaatagataatggaacgcgtctttcaggacgtcgcgaatagattttcctttttccagcacggtatgctgatccagatagccgacacggacattttttgaccattcgacttttccctcatcaggttcaagctttccggtaataatattcatgaaggttgattttccttcaccgtttgcgccgatcaagccgacgtgctcgccttttaacaggcggaaggaaacgttattaaaaatggcccggtccccgaagccgtggcttaaatcctttacagataaaatactcatgtttacacctctatcgttatcaaacacgcacaatcggcgtgtaatattcacccttttgattataaaggaggattcggaatgttgaaaggtataggaaagaaaaagaaaaattgcgttccgggcgaggttttgagatactatggaatagatttcaggaattgaggagaacaaaatgacgcaaacttggccatttttacataatgcacaatcatttatacaagagaattggaatgcttccggctttcaaacgccaacccctgttcaagagcaggcagcccagctgatcatggacggaaaggatgtcatcgcggaatcgccgacaggcacaggcaagacgctggcgtatgcgctgccggtcttggagcggatcaaaccagagcaaaagcatccgcaggcggtgattttagcgccttcccgtgagctggtgatgcagatttttcaggtgattcaggattggaaagcgggctcagagctgcgcgcggcttccttaatcggcggggcgaatgtgaagaagcaggtcgaaaagctaaagaaacatccgcatatcattgtcggcacgccaggcagggtatttgaactgattaaagcaaagaaactcaaaatgcatgaagtgaaaacgattgtacttgatgaagcggatcagcttatcctgccggagcatcgcgagacgatcaaacaaattattaaaacgacattaagagaccgccagcttctatgtttctctgccacgcttaaaaaggaaacagaggatgtgctccgcgaattggcgcaagagcctgaggtgttgaaggtgcagcgaagcaaggcggaggcagggaaagtgaaacatcaatacctgatttgcgaccagcgcgacaaagtgaagctgctacaaaagctgtctagacttgaaggcatgcaggcactcgtatttgtgagagacattggcaacctgagtgtatatgcggaaaaactggcatatcaccacgttgaactcggcgttttgcacagtgaagcgaaaaaaatggagcgggcaaaaatcattgccgcattcgaagacggagagtttcctcttttattggcgactgacattgccgcacgcggtttagacattgagaacctgccatacgtgattcatgctgatattccagatgaagatggctatgtccacagatcaggacgaacaggccgggccggaaaagaaggcaacgtgctgagccttgtgacaaaattggaggaatctaagctgaaaaaaatggcgaagaagcttggtgttgagctgagtgaagctgtgtatgcaggcggaaaactgaagacgaaataaaaagaagggcgaaaagccctttttttgttgtaaaataatagaaaaagtttcgcgcagggggtgggaaggtggtttcaatagacaggtttcaagcagtgaaggagtcagagctgaaaattcttgaaagctggtttgagaatgaggataccagacggagaatggatgggatgctgccattagatgagtggtatgcacgagtaaataaagataaacacgatactgtcatcatggcgtatgatggacagctgccggcagggatggtcgttattgagttcggggagaagcggacatatattggattgatcgtcaatcctttgtaccggcttcaagggtacggaaaacggatattgcaaaagctgatgaccgaacctgattttactagcgtgcgggaatgggtggcatgcattgaagaagacaatcgaatcagtttagcttgctttcaagcagcaggattcactttggaagatacagaacctgatgaagatggttttcttacgctgattcttcgcagctgatctcatcgaaacataaaaggagggcaaaaagccctcccgttttcatcttcattcagctcggatcactgaccttgatcagctgtttccctttattttctcccttaaataaaccgagaaacgcgtcaggaatgttttcgaagccttctgtgatggtttcctcgtaatggagtttaccagccttcagccattcggccagctgttttgctccctcagaaaaacgatcggagtagtcgcttacgataaagccttgcatcagcgacttcgttttaatgagttttgattggacacgagggcccatgtcatctgcttcgctttctgcgttataggaagaaatggcgccgcacaccggaatgcgggcaaattcattgagcagattcatcaccgcgtctgaaatcggtccgccgacattgtcaaaatacacatcgacaccgtcaggacaagcgttttgaagcgctttttggatatcatccgctgttttgtaattgatggcttcgtcaaactgaagctcctgttttaaatagtcgattttttcatcagaacccgcgataccgacaactcgcgcgcctttgattttggcaatttgcccgactgttgaaccgacggctcccgcagctccggagacaaccacggtttcgccttccttcgggcgtccgatgtccagcaatccgaagtatgctgttaagccggtcattcccaaaatgccgagataggccgaagcgggagcaaggcttgtatcaatttttcgcaaggcagactcgctcacagcggaaaattcctgccagctgagatttccgatgacgatatcgccttttttcaattggtcgccgtctgacacgacttcagcgataaccccaccagaaagcgcttcatccaaggcgaacggcttaacatatgacttcgtatcctgcatacggccgcgcatataagggtcaaccgaaacataaagcgttttgacaagcacttccccttgctggggttcaggaaccggaatggtttcaaagcgaaagtcttcatgaacaggaataccttgtggacgtcttgctaattgaatttgctgctgagatgctgtcattttcatcctcctatcacttggttgacaccactgtaacatggacaggagaggaaatacaaaaggtaagctggcatacaaaaaaggagagggggctcctctccttttcatttcgcccgtaatttcgggcacagtcccgtcggcaggcacattggcttctggtcgatcgggcttctcatgatgcagcattccaagccgaagacttcacggaaaaatggctgggtgaacacatcttccggtgttccggcgttgtatatttttccgtccagcacactgatcagatagtcagcgtattgagcggcttggtttaaatcatggagcaccatgacaacggtgcggccatggtcgcggttcagctttttcagcagttcaagcacttcaatctggtgtgagatgtctaaatacgtggtcggctcatcaagcaaaagcaaatcagtgccttgcgcaagtgccattgaaatccaggctctttgtctttggccgcctgaaagggcatccagcgtccgatccttcagttcaatcatgcccgttgcttccagcgcccactctaccatgtcatgatcctcttgggtatgcttggataacagctttttgtgaggatgtctgccaaaatagcataattcctctaccgtcaatccttcaggggcctgaggagattgtggaagaatggccagtttttttgcgacttcttttgatggctggcggtggatgtcttttccttctagtagcactgtaccgcttttcggggccatcagcctggcgagcgatttgaggattgttgatttaccgcagccattagcgccgatgagcgcagtgatttttccttcttctatctttaagtcgactccgtcaataatcactgtactgtcatatgaaagagtgagctggtctgcagccagttttcccatggtatcctctccctactgtttcctcgcttcgaatttcaataaatataagaaataaggcgcgccgatcacggctgtcagtattccggcaggtatttcaaccggaggcatgatgccgcgccctaacgtatctgcaattaataatataatagcaccaatcaatgccgatgcaggcagtaaatatttagctttttctccggtaagccgtctggcgatatgcggagcaagcaagccgataaaaccgattgagccgacgacggctacacagcttcccgccagcgccaccgcggtgaaaatcaggatgaatctcagccggtttgcgttttctccgagaccctgtgcaagctcatccccgagtgacataagatccagcttcggtatgagtatgcagacgatcggaaaaagaatcaaaagccatggcgcaagcagcttgacttcttcccagtttcttccccagaggcttcctgtcagccaaatgagtgcagcattcacgtcgcctggaaactttaccatcatatattgcattccggcatggcagaccgcgcctaaagcaatgcctgataaagccagtgaagagggctgaatgctcttttttcgggctatcattaataatagtacagcaataatggcggctccggcaaatgcggagaacggaagcacgtataccggcgactcaggaaagatgagaatcacagccatcgccgcaagtccggagccttttgaaatgccgacaacgtccggggaagcgagcggatttcggatcacaccctgtaaaatcgctccggcagcggcaagcccagcaccggccaaaatcgctaatataatgcggggaaggcgatattgctggatgataaattcaaaggaatgatccagtcccagcagattcgtcactaccgcatcaggtgaaatgtataatgcaccgattccaatgctgatgacggacagaacgattaaaatcacggccaatatgagtatcgccagtaaggggcgtttttgttttctggttgttttcttcatttcaggtttcgccctttccttgccaaatataagaaaaacggcgttccgataatcgcggtgacaatgccgaccggtgattcataaggaaatgcaatccatctggccagaacatctgcgtacaccagcaaaatggcaccgaacagtgccgaaaacggaagcacgtattgataatgttctccgatcagcttgcggacaatatgcgggacgagcagcccgacaaagccaatcggcccggcgacggctacggaagcgccggaaaggattaaaataatcaaactgatcagaatccggatgccgttcatattttgtccaagcccttttgctgtttcgtctccgagaccgagaacagaaacagaaccggaaaatacgagggcaagcccgatgccaatgacagaaaacggagcgatggttatgacatcctgccagttgctgccgtcgattgcgcctgtcatccagtacagaacatcctcacctgactcatttaaaataatgatggcctgtgtcatagaggagaggaacaaatgcacggccattcctgacagcgccagcttaacaggtgtcattccgccggatgaggcaatcatatacacaatcgcaccgcctgctgccgcacccgcaaaagcgaatataacagatgaatagggcgatgccggcagaatgacgagagaagcaacgacaaaaagcgatgcacccgcattcacaccgaaaatttggggtgaagccagaggatttctggtcatagcctgcatcagcgcccctgctacagctaggctggcgccgacaaaaacgccgattaatgtgcggggaaggcgaagagtggagatgatgagctgttcctttgaaccgtcccatacaaaaagatatttcaatgaatctatgatgccgatgtctgaggctcctactgaaagattcagcccaagcccaaatataaaaataatcagtgcaatgatgaacatcatcagtcttgatgatgagcgccgtttggctgaatgatacaacagtctcacttccttactgcgtctggttgcaaaaacgaagaagcaaggatttcccctcgcttctcatttgtcctatttattatacacttttttaagcacatctttggcgcttgtttcactagacttgatgcctctgaatcttgtccaagtgtcacggtccgcatcatagacttgtccatttttcaccgctttgagatttttccagagcgggttcgttttccactcgtctacaatggttttgccttcgttggctgagatgaacaaaatatcaggatcgattttgctcaattgctcgaggctgacctcttgataggcgttatctgacttcacggcgtgtgtaaagccgagcattttaaagatttctccgtcataggatgatgatgtatgaagctggaaggaatccgctcttgcaacgccgagaacgatgttgcggttttcatctttcggaagttcggcttttagatcgttgatgacttttttgtgctcggcaagcttttcttttccttcatcttctttatttaatgctttagcaatggtcgtaaagctgtcgatcgtttcgtcatatgtcgcttcacggctttttaattcaatcgtcggagcgatttgtttcagctgtttataaatgtttttatggcgctcagcgtcagcgatgattaaatcaggcttcaaggaactgatgacctcaagattgggttcgctgcgtgtgcctacagatgtgtaatcaatggagctgccgacaagctttttaatcatatcttttttgttgtcatctgcgatgcccaccggcgtaataccgagattgtgaacggcatccaagaatgaaagctcaagcacaaccacccgcttaggtgtgccgcttactgtcgtttttccttcttcgtcatggatcactctggaatccttagacttgctttcgccgcttccgttgttattctggcttgatgaacagccggatacaatgaggcaggcgagcaataaaacactcatgatggcaatcaacttgttagaataggtgcgcatgtcattcttccttttttaagatttagtaatgagaatcattatcacatgtaacactataatagcatggcttatcatgtcaatatttttttagtaaagaaagctgcgtttttactgctttctcatgaaagcatcatcagacacaaataagtggtatgcagcgttaccgtgtcttcgagacaaaaacgcatgggcgttggctttagaggtttcgaacatatcagcagtgacataagggaggagagtgctgagataaccggacaatttcttttctatttcatctgttagtgcaaattcaatgtcgccgatattcatgataatcgagaaaacaaagtcgatatcgatatgaaaatgttcctcggcaaaaaccgcaagctcgtgaattcctggtgaacatccggcacgcttatggaaaatctgtttgactaaatcactcacaatccaagcattgtattgctgttctggtgaaaagtattgcattagacatacctcctgctcgtacggataaaggcagcgtttcatggtcgtgtgctccgtgcagcggcttctctttaattttgatttttctgaaaataggtcccgttcctatcactttaccatggacggaaaacaaatagctactaccattcctcctgtttttctctttaatgttctggaatctgtttcaggtacagacgatcgggtatgaaagaaatatagaaaacatgaaggaggaatatcgacatgaaaccagttgtaaaagagtatacaaatgacgaacagctcatgaaggatgtagaggaattacagaaaatgggtgttgcgaaagaggatgtatacgtcttagctcacgacgatgacagaacggaacgcctggcagacaacacgaatgctaatacgatcggagccaaagaaacaggtttcaagcacgcggtgggaaatatcttcaataaaaaaggagatgagctccgcaataaaattcacgaaatcggtttttctgaagatgaagccgctcaatttgaaaaacgcttagatgaaggaaaagtacttctctttgtgacagataacgaaaaagtgaaagcttgggcataaagcaaggaaaaaaccaaaaggctatgacggccttttggtttttttgcggtctttgcggtggcattttgcagaatgccgcaataggatagcggaacattttcggttctgaatgtccctcaatttgctattatatttttgtgataaattggaataaaatctcacaaaatagaaaatgggggtacatagtggatgaaaaaagtgatgttagctacggctttgtttttaggattgactccagctggcgtgaacgcagctgatttaggccaccagacgttgggatccaatgatggctggggcgcgtactcgaccggcacgacaggcggggcaaaagcatcgtcctcaaatgtgtataccgtcagcaacagaaaccagcttgtctcggcattagggaaggaaacgaacacaacgccaaaaatcatttatatcaagggaacgattgacatgaacgtagatgacaatctgaagccgcttggtctaaatgactataaagatccggagtatgatttggacaaatatttgaaagcctatgatcctagcacatggggcaaaaaagagccgtcgggaacacaagaagaagcgagagcacgctctcagaaaaaccaaaaagcacgggttatggtggatatccctgcaaacacgacgatcgtcggttcagggactaacgctaaagtcgtgggaggaaacttccaaatcaagagtgataacgtcattattcgcaacattgaattccaggatgcctatgattattttccgcaatgggatccgactgacggaagctcaggaaactggaactcacaatacgacaacatcacgataaacggcggcacacacatctggattgatcactgtacatttaacgacggttcgcgtccggacagcacatcaccgaaatattatggaagaaaatatcagcaccatgacggccaaacggatgcgtccaacggcgctaactatatcacgatgtcctacaactattatcacgatcatgataaaagctccattttcggatcaagtgacagcaaaacctccgatgacggcaaattaaaaattacgctccatcataaccgctataaaaatattgtccagcgcgcgccgagagtccgtttcgggcaagtgcacgtatacaacaactattatgaaggaagcacaagctcttcaagttatcctttcagctatgcatggggaatcggaaagtcatctaaaatctatgcccaaaacaatgtcattgacgtaccgggactgtcagctgctaaaacgatcagcgtattcagcgggggaacggctttatatgactccggcacgttgctgaacggcacacagatcaacgcatcggctgcaaacgggctgagctcttctgtcggctggacgccgtctctgcatggatcgattgatgcttctgctaatgtgaaatcaaatgtcataaatcaagcgggtgcgggtaaattaaattaagaaagtgaaaaacacaaagggtgctaacctttgtgttttttaattaattaaaatgtttattaacttagttaaggagtagaatggaaaaggggatcggaaaacaagtatataggaggagacctatttatggcttcagaaaaagacgcaggaaaacagtcagcagtaaagcttgttccattgcttattactgtcgctgtgggactaatcatctggtttattcccgctccgtccggacttgaacctaaagcttggcatttgtttgcgatttttgtcgcaacaattatcggctttatctccaagcccttgccaatgggtgcaattgcaatttttgcattggcggttactgcactaactggaacactatcaattgaggatacattaagcggattcgggaataagaccatttggcttatcgttatcgcattctttatttcccggggatttatcaaaaccgggctcggtgctagaatttcgtatgtattcgttcagaaattcgggaaaaaaacccttggactttcttattcactgctattcagtgatttaatactttcacctgctattccaagtaatacggcgcgtgcaggaggcattatatttcctattatcagatcattatccgaaacattcggatcaagcccggcaaatggaacagagagaaaaatcggtgcattcttattaaaaaccggttttcaggggaatctgatcacatctgctatgttcctgacagcgatggcggcgaacccgctgattgccaagctggcccatgatgtcgcaggggtggacttaaaatggacaagctgggcaattgccgcgattgtaccgggacttgtaagcttaatcatcacgccgcttgtgatttacaagctgtatccgccggaaatcaaagaaacaccggatgcggcgaaaatcgcaacagaaaaactgaaagaaatgggaccgttcaaaaaatcagagctttccatggttatcgtgtttcttttggtgcttgtgctgtggatttttggcggtagcttcaacatcgacgcaaccacaaccgcattgatcggtttgtccgttctcttattatcacaagttctgacttgggatgatatcaagaaagaacagggcgcttgggatacgctcacttggtttgcggcgcttgtcatgctcgccaacttcttgaatgaattaggcatggtgtcttggttcagtaatgccatgaaatcatccgtatcagggttctcttggattgtggcattcatcattttaattgttgtgtattattactctcactatttctttgcaagtgcgacagcccacatcagtgcgatgtattcagcatttttggctgtcgtcgtggcagcgggcgcaccgccgcttttagcagcgctgagcctcgcgttcatcagtaacctgttcgggtcaacgactcactacggttctggagcggctccggtcttcttcggagcaggctacatcccacaaggcaaatggtggtccatcggatttattctgtcgattgttcatatcatcgtatggcttgtgatcggcggattatggtggaaagtactaggaatatggtagaaagaaaaaggcagacgcggtctgcctttttcttattttcactccttcgcaagaaaacggattttgaaaaatgagaaaattgcctgtgaaaaatggtatgatctaggtagaaaggacggctggtgctgtggtgaaaaagcggttccatttttccctgcaaacaaaaataatggggctgattgcggctctgctggtctttgtcattggtgtgctgaccattacgttagccgttcagcatacacagggagaacggagacaggcagagcagctggcggttcaaacggcgagaaccatttcctatatgccgccggttaaagagctcattgagagaaaaggcggacatgcggctgagacgcaagaggtcattgaacaaatgaaagaacagactggcgcgtttgccatttatgttttggacgaaaaaggagacattcgcagcgcctctggaaaaagcggattaaagaaactggagcgcagcagagaaattttgtttggtggttcgcatgtttctgaaacaaaagcggatggacgaagagtgatcagaggaagcgcgccgatcataaaagaacagaagggatacagccaagtgatcggcagcgtgtctgttgattttctgcaaacggagacagagcaaagcatcaaaaagcatttgagaaatttgagtgtgattgctgtgcttgtactgctgctcggatttattggcgccgccgtgctggcgaaaagcatcagaaaggatacgcttgggcttgagccgcatgagatcgcggctctatatcgtgagagaaacgcaatgcttttcgcgattcgagaagggattattgccaccaatcgtgaaggcgtcgtcaccatgatgaacgtatcggcggccgagatgctgaagctgcccgagcctgtgatccatcttcctatagatgacgtcatgccgggagcagggctgatgtctgtgcttgaacaaggagaaatgctgccgaaccaggaggtaagcgtcaacgatcaagtgtttattatcaatacgaaagtgatgaatcaaggcgggcaggcgtatgggattgtcgtcagcttcagggagaaaacagagctgaagaaactgatcgacacattgacagaggttcgcaaatattctgaggatctcagggcgcagactcatgaattttcaaataagctttatgcgattttagggctgcttgaacttggggagtatgatgaagccattgatctgattaaagaggaatatgcgatgcaaaatgaacagcatgatcttttattccataacattcattcgcagcaggtgcaggccattttgttagggaaaataagcaaggcatcggaaaagaaggtcaagctggtgattgatgagaacagctcactcgcgcctcttcctgcacatatcggcttgtcccatcttattacgattattggcaatttaattgataacgctttcgaagctgtagcggagcaaagcgtgaaggaagttttgttttttatcacggatatgggccatgacattgtcattgaagtatcagacacagggcccggtgtgccgccagagaaaatagaagctgtgtttgagagaggctattcttcaaaggggatgaggagaggctacggtctggccaatgtgaaagactcagtgcgtgaactgggcggctggatcgaactggcgaatcaaaaaactggcggggcggtattcactgtgtttataccgaaggagaaacaaaggggaatccatttgattcacatcgcgattgcggaggatgattttcgagttgcgcaaatccatgagagattgattaaacagcttgatggattcaagattatcggcaaggcggctaacgcaaaagagacaatggcgcttttggaggaacacaaggctgatttgcttctgctggatatttatatgccggacgagcttgggaccgcgttgattcctgatatacgaagccgatttcctgaagtggacattatgattatcacagcggcaacagaaacccgtcatttgcaagaagcgctaagggcgggaattgcccactatttgatcaaacccgtaacggctgacaagttcaggcaggtgctgcttcagtataaagaaaaaaggaagctgctcatgtctcagccggaggtcagccaatccatgatcgaccatatttttgggaacagtgtgaagacagctttgccggcagaggatttgccgactggcattaattcgattacactgcgaaaaattaaggaagcgcttcagactgcgtcagaaggattgacagcggaggaacttggggaaaaaatgggggcgtcacgaacaactgcccgccgttatgccgagtaccttgtgtcaaaggaagaagcaagagccgagcttgaatacgggattatcggcaggccggagagaaaatattatttggcggcggattagatatgaaaaaatctataatcctattgattattctattgatctttatgcagggtgatatcaggcaggcggctgcgccgcgcctgccggacgggccgatagaaattgtcgtccctgccgaaccttctggcggctgggatgtcacagcgcaggcgatccaatcagttttgaggcagaagcagatcgtgaaggatgatgttcatatcgtctataaatccggcggcgggggagagaaaggctggaaatatgtcaacaaaagcagcaaacaaaccatcagcatgacgtccagcctaatattgagcaatgatcttctcgggcaaagcaaattaaaaatgtccgattttacgccgctcgccattctctccaaggaatggcagacggttgcattgccaaaaggatcagcgttaacaaatggcaaagatgtgctgaatgagatcaacatgcatcccggcaaggtgagaatcggctttgccccggggtttggcaatgatgatcagctctcgttcgtcagagcggcagatatgtacggcattgacccgtttgacattcaattctcacagtatgacagcagcgaacagctcattcaggcgctgatcagacatgagatagaagcggcttccatgacactttctgaagcgaaaccatatgaacgaaacggcgatatcacgttagccgctgtaacgtctgataaaaggcttcccggttttccaaatgtaccgacgtggaaggagcagggaatcccgtttgttttttctcattggagagggattttgggcccgaaaaatatgtccgaggaagagatttcttactgggatcaagcgctaaagaaggtcacctcctcacctgaatggaagcggaaaataaacgagcaggactgggaaagcttttatttaaacagcagggaaacgaaacggtttttagaagagcaatctgctttttatcaaagcatcatgacaggaaattaagatcccggcatcccgggatttttttcatgccgaaaattgatcaaaaagaacaaaacggttttaaaaaattaaaaatacaaaaaaaacaaattatttacttgcggttggttttcccatacgatggcaaaaaggtaagacaaaaaggggagtaagggagaaaaaaatgtaagcggattcatttaagggggaatggatgtgttagcaattttaggctttctcatgatgcttgtgtttatggcattgatcatgacaaaacggctttctgttttaacagcattagttttgacgccgattgtgtttgcgcttatcgccggatttggatttactgaagttggggacatgatgatttcggggattcagcaagtcgcgccgactgcggtcatgattatgtttgcgatcttatattttggaattatgattgatacaggcctgtttgatccaatggttggcaaaattttaagcatggtcaaaggagaccctttaaaaattgttgtcgggacagcggttcttacaatgctcgtcgccttggacggagatggctcgacaacgtacatgattacgacaagcgccatgcttccgctctatttgctgctaggcatccggccaattatcctggcgggaatcgcgggagtcggcatgggaatcatgaacacaattccatggggcggtgcgacgccgagggcggcgagtgcgctgggggttgatccagctgagcttacagggccgatgattcctgtcattgcaagcgggatgctttgtatggtggcggttgcgtatgtgcttggaaaagcggaacgaaagcgccttggtgtgattgaactgaaacagccagccaatgccaatgaaccggcggcagcggttgaagatgagtggaagcggccgaagctttggtggttcaatttattgttaacgctttctttaataggatgtttagtatcgggtaaagtcagtttaaccgtactgtttgtcattgcgttttgtattgcgctgattgtgaattatcccaatctcgagcatcagagacagcgcatcgcggcgcattccagcaacgtgctggctatcggttcaatgatttttgccgcgggggtgttcacggggattttgacaggcacgaaaatggttgatgaaatggcgatctcgctcgtgtccatgataccggaacaaatgggcggattgatcccagcgattgttgccttaacaagcggtattttcacatttttgatgccgaatgacgcgtatttctacggggtgctgccgattttatcagaaacagctgtcgcatacggtgtggataaagtggaaattgccagagcctctattatcggccagccgattcatatgctgagtccgcttgtgccatccactcatttgcttgtcggactcgtcggagtttctattgatgaccatcaaaaattcgcattgaaatgggcggttctcgcagtgatcgtcatgacggctatcgctctattgatcggtgcgatctctatttccgtatgataattcaggcgtaatgacacacactaacggcatataacattccggaggtgtcattatgagtgatccttatatgccgctgacttcagtcagaagcggaacggggttcgaagcggcaaaaggggtgcacggcctgactgtgcaaattgcgaatgtctattttattcagctgccttctgaacctcactcatttgttttaattgatgccggcatgcctcaatcagccggcatgattgtcaatgaagccaaacaaagattcggtgaagagtttcagctgaaggcgattatcctcacacacgggcactttgaccatattggggcaatcgaagagatccttgagcattgggatgtgcctgtttatgtccattctcgggaaatgccctatgtaacaggtaaagaggattatcctccggctcgtcctgacagcaagagcgggctggtcgccaagctgtcgccgctgtttccgcggcactccatcgatatttcctcacatgtccaggcactgccggaagacggttcagttccttttcttgacgagtggatgtggattgcgacaccaggacacacgccgggccatatttcgttattccgcgatgacggccgcgtgcttgtggcaggtgatgctgttattacagtggaacaggagaaaatggctgacgtcttgatacaaaaacaggagcttcacggtccgccggcttatttcacgcctgacacagagacggccgctgagtccattctgaagctggccggtcttgaaccggaagcgttattgacagggcacggcataccgatgaccggcaaaaactttcgaagtgacttaactgaattggtaaatcgattatcgtctatttgacacccgcattacgcgggtgttttttattgttttccaggaagttgcagaaaaatcatttgtcttgccgcttaaaaacgatacaatgaaaagcatgaagtgatgtgaaggggagagtttgttggaagaaaaagaaatactctggaacgaagcgaaagcgtttattgccgcatgctatcaggaattgggaaaggaggaggaagtgaaagaccgtctcgaggacattaaaagcgaaattgacctgaccggaagctatgtacatacgaaggaagagctggagcacggagcgaaaatggcttggagaaacagcaaccgctgcatcggcagattgttctggaattcgctgaatgttattgacagacgagacgtccggacgaaggaggaagtgcgtgacgccctctttcaccatattgaaaccgccaccaataacggcaaaatcagaccgaccattacgattttccctccggaagagaagggtgaaaagcaagtcgagatctggaatcatcagctgatccggtacgctggatatgagtcagacggagaaagaatcggtgacccggcttcctgttcactgacagcagcctgcgaagagctcggctggcgcggagagcgaacggattttgacctgctgccgctcatttttcgcatgaaaggcgacgaacagcctgtctggtatgagctgccgcgttcacttgtgatcgaggttccaatcacacatccggacatcgaggcgttttctgatttggagctgaagtggtacggcgtgcctatcatctctgatatgaagcttgaggtcgggggcattcattataatgccgcgccatttaacggctggtatatgggcacggagatcggagcgagaaacctcgcagatgaaaagcggtacgacaagctgaaaaaagtagcgtccgtgatcggcatcgccgctgattacaatacggatttatggaaggatcaagcgctagttgaattgaataaagctgtgctgcactcgtataaaaagcagggtgtcagcatcgttgaccatcatacagcggcaagccagtttaaacggtttgaagaacaggaggaagaagcgggcagaaagctgacgggagactggacgtggctgattccgccaatttcacccgctgccactcatatcttccaccgctcctatgataactcaatcgttaagccgaactatttttatcaagataagccttatgagtaaacaatagaaaatcgatgatggccttcaaggctgcgggattcagtcacagagatgtcggtaacctttgagaaagggcttccgttctttacagcctcaacaaacgattgcagggcgttttccggaccctctgccaaaatctcgacacgcccgtcatcacggtttttgacccagccggccagttttcgcttatcagcttccatttgaacaaaatagcgaaagcccacaccttgaacccggccgtttacaatgattcggtattgaagcatgtaaaaaccaccttttctttttatgatactcaatcattttacaacctgtaaaggggatgtgtttgtatgaaaccagagcgctattcagttctttctcttaatctgggaaaaccgcagacgcttgaatatgacggaaagaaaatcgaaaccggcatcatgaagcggccggctgaatcagccgtcatgctgtatcgggagaattttgaaggagacggacaggcggacctcgtcaaccacggcggacctgataaggctgtctgtgtctacccggcggagcattatccgttttgggaagagttcctctcaagaccgctgtcaaatgccgcatttggagaaaatctgacggtcgcgggcctgactgaggagaatgtttgcatcggggatgtgttcaggcttgaggaagctgttgttcaggtcagccagccgcgccagccgtgtgtaaagctggcgaaaaagtttggtgtaaaagaaatggtgctgaaggtccagcaaaccggctatacagggttttattttcgcgtgctggaggagggcagggtgtctcccggcgcgaaccttgaattgctgtccagaggagagaagggcatctccgtccagttcgccaaccgcatcaactaccatgatgcaaaaaatctcaccgccatagaactgattttaagtgaggctgcactatcggaaagctggagagcgtcctttatgaaaaagaaggacaggctgctgccggttgaatagaaaaaagccgcgcatatcaacgtgcgcggctttgccatatttaagattgttttttctttgtttcaagcaggttggcaagaaaataggttttatagctttgaagctttcttccctcatggtgcgtgatcccctgcttttttagttctgccacataccagcctttactgccgtaatgcatgtcagaaaactcctttccctatctgatttcgaaacgattggcattgtaacatctataaaaagatgctgaaaagagatgcggggaaaactgagcctttcgcactagatgtacgaatgttcttctgtatgtatatgcggagcaaaagccgaatatgatttaatggccggttagtttgatcatgacaacgccaaatgtcataatggcgaaaacaatgccgatatatgtgagcatcccgttttttttcttaacgccgtaaacggtcataatgatgccttcaatgaaaaaaatgatgccgaaaataataaaccacatgcagataaaggctcctttcacagacataatagtagtgtagcatatctgaaagagccgggctgtgacaatatcaagaaagccgggcgcataccgcccggctcatgttttattgtttatcaaccaatttgaccagaagctgtgccaaatgttctttctcatcttcgtctgcaacgctccaaagctcttgcagcagcatttcttcaccgttttgcggctcttcatgctttgcgaggtagtctcccaggatcgcagcgctttttacaagcttgccgtcatccaatcccagctttttgcctcggttgacttgttttttcaggtagcctttaaattcctcaaagtcttttaaaatgtcttcttttattgtgccatgcatcgcgttcatttcgttttcaatttggattttttcttgatctctgttcattgcaagacctcctcgtgcagaataatgatgttttacctgctattggaggaggttaaacctgccggaagcccggaatgtgttttacagtttcgtcaggataatcggttcatcttttgtgatgacgatcgtgtgttcaacttgggcaaccatgcttttatccggcgtcttgaacgtccagccgtctccagcttcaacaatcgtttctgctttcgttgaaataaacggttcaagcgcgatgactgtgccatttttgaacagtgcgttatcaaacggatcataatagttcatgatgtggttcggcgcttcatgcaggcttcggccgattccgtggccggtcagggttttgatgacggtaaagccttgagagcgtgcttcatgataaacggctcttccgatctggttttggcgcttgcccgcttttgcctgctgaagccccttttgaaatgcgttttccgcgcattggcaaagcttatgaaggcgttcttctccttcaccgagcacaaatgagatgcctgtgtcggaatagaagccgccaaattcagcggagatgtcgatgttgacaaggtcccctgcttttaaaattttggatgtgcttggtatgccgtgagccacttcatcatttacgctgatgcatgtcacacctggaaaatcgtattccttctcaggagctgaaacggcgccgtgctcatcaagcacagcttttccgataaggtcaaggtcttttgtgctcatgccgggctctgccttccgcttcatttcttcacgcgcaagcgcgacgattcttccgatttttttcaggccttctaattcttgatcgtttgttacaatcatctgtcattcccgctttctttttaaataatctagattaagcttaccacaactgtcttaaaaataggaaacacacgggcctgggaaaaaagaaatacccccgggaaaattggtatagatcactagatatcttatatggtatatttgaaaaaaaagggtatgagggggatgggtatgctttcatttttacaaaaactcgggaagtcatttatgctcccgattgcggttctgcctgcggttggaattatccttgcgcttggcagagaggatgtatttaatatcccgtttgtctatcaggcggggacggcggtttttgatcatctgccgcttatttttgcgatcggaattgccatcggcatttcaaaagacagcaatggggccgcgggtttatcaggggcgatatcgtatctgatgcttgacgcggcaacaaagacaattgataaaacaaataacatggcggtgtttgggggaattattgccggtttaattgccggttacacctataaccgcttcaaggataccaagctgcctgaatatctcggattcttcagtggcagacggcttgtgccgattttaacagccattattacgatcattttagcgggcatattcggagtcgtctggccgccgattcaatcgtgtataaactcgtttggagagtggatgctcgggctcggcggcatcggggcaggcatattcggcctattcaacaggctgttaattccgcttggccttcaccatgtgctgaacaatattttctggttccaattcggagaatataacggagtgacaggggatttggcgcgctttttcgcgaaagatccgacagcgggcacatatatgaccggattcttcccaatcatgatgttcggtcttccggcggcgtgtctggctatggttgtgactgcgaagccatctaaacggaaagcgacggctggaatgatgattggatttgctttaacggcgtttatcacagggattacggagccgattgagtttgcatttatgtttttatctccgcttttatacgctgttcacgcggtcttaaccgggttatctttatttatcgtcaactggctcggcatccgttcaggcttttctttttcagctggagctatcgattatgtgctcagctatggaatcgcagaaaaaccgctgcttctgcttttggtaggtatatgctatgcggcagtatactttatcgtgttttatgtactgattaaggctttgaatttaaaaacgcctggacgggaagacgatgatgtagatgaagtgctggatgaaaatactgttcaggatgtaaatgaaaacatcatgctgaaagggctcggcggaaaagaaaacattcaaaccattgatcattgcgccacaaggctgcgactgactgtgaaggataccgctttggtggatgaagcgctgctaaagaaagcaggcgcaaaaggggttgtcaaatcaggggggcaatcggttcaagtcattattggcccgaatgtggaatttgcggcggaagaattgagggctgctgtcaaataaaaaagcggagaggttgccctctccgctttttcttatttatcttcgttatcctttgacgtttcggaagaatcttcgtcatgttttgtgtaatcataatcagaaggattcaccttcttaaaacctttcggctcgtagaaccgcagcaggtctccgtttatgattttatcggacatttcaagttccttcttgacgagcgagtcttctgacttgtcgacttcggattcatcgagttcttttccggttttcgtgtcgtaatacttaccggatattttcgtgtacttcggtgaaataaagtctccgtttcggaacggaatcacttcacggtgttctttcgataaaatatcagaaccggacatcagatagtccttcgtatccactccgagcagatgcagaatggtaggagccacatcaacgtctccggcatatttatgaactttctcgcccttcacgccggcagcgtggataaagagcggcacccgttgaagctgggcgttgtcgtaatcagtgatttcatctttgccaagcactttcgccatcgctttattgtggttttcagagatgccgtagtggtctccgtacatcacaataatcgatttatcatataacccgtcttttttcagatcattgaagaattgttcaatggactgatcaaggtaatgggctgactggaagtagttatcgacgacagagtcaccaaagtctccagccgggaagtctgtatccccctcatccattccgaatgggaagtggttagacagggtaatgaacttcgtatagaacggctgcggcaggctttccagcagcggcattgattctttgaagaacggtttgtctttcatgccgtagtttttcgtgttttcttcgttcatgtcatagtaagcagaatcaaagaatttatcaatgccttccgctttgtacatttcgttacggttccagaacgtctgcgtgttcccgtggaaagtagcagatgtgtaattcttagacttcagaatcgccggaacggattgcagcgtgttttgcgctttgtttacgaaaactgaaccttgagccagcgggtacagagagttttccatcataaattcagcatcagatgttttaccttgtcccgtttggtggaaaaagttatcaaagtagaacgtttcgttatcatgtgccagtttatttaagaacggtgtcacttctttgccgtcaattttatagtcgatgataaatgactgcaaagattcaagtgaaacgtaaatgacgttttttccttccgctttgccgaaatacacgttattcggcacatcgtaattggctttcatgtagttttctacttccgtcacgtcgctggaatcggcaagcgcgcgctggctgttggacttgatattctgtacagcgtcataaatcgtgaaattgtatgttcccaagtatttcacaagatagttccggtcgaatgatcttgtcagcaattcaggacggtctgattccgcaactgccaggttgatcaagaacacaagaattgaagacgcaaaaataattcggaacgattttttgcttgacgtttcggcaggcttgtttactttgatcgccaagatgatcaggatgatcgtatcgataaagtaaaaggcgtcagtcggtctcatcagcgaaaatgcgctgtcaccgagttggccgccgtttgttttagcctgcataatgaccggaattgtaataaaatcattgaaaaatctgtagtacacaatgtttgcgtacagtaaaaaagacattaaaaaatgaatcactataatggctgtctgctgtaattttttcttgaacaagagtccaaagccaagaaagaacaagcttgagctaagaggattcacaaaaagcaatattttttgtatcgtgttgtctattcctaagttgaagttcaggacataaccgacatacgttttgatccataacaggacgaccgcaattaagaagaaggccagtcctctttcttttataaatgttttcattgttacactccttttttccgatccagttcgagcgaaacgatagaaaaaacgaacgtatccaatataacacgaatcagcagattagaaaagtgaaaatcgtatgatggagaaagtggcgaaaaacgccgtcgaatcaacgtttcgctttgatattaccaaatgtaaaacaaggtatctttctagaaataaaggaataaaatggtacattgagaattgtatgataaaatataaggtatagataaaaagaggtgaaatgatggatttttcccatattgtgtctgaagataaaattaagcgcgccatcaaagacggggactttcaaaacctcccgggaatgggaaagccgctgccgaaggatgacgcggcacacttgccggaatcgctgcgcatgggctatcgtattttgaaaaacgcgggaatggcagaggacgagggcgcgctcaaaaaagagcttatgaccatcgaccatttaatcgaaaagtgctatgacgaaaaagaacgcgagcaattaatcagaaaaaaatctgaaaaacaattgctgcttgataagcttgtcgacaaaaaaggcatgttttcaaagccagcatccgctttttataagaataaagtatatgaccggcttggacgaaacagaccttcttccagctgatttgtcttgtctgcaggatggcgtttgttaaaagccatcctttttatggtccaagttctatgtcaaaaggtttatgtttttccatctatgggaaatgacccataaacgaaaaaagggtgatgggatggaacgactattagtatggatagagcatatatctgattggctgtggggtccgccgctaatcatcctgctgacggggacggggttgtatttcactattttgctgaaaggttttcaatttcgctatcctttatacattttcaaacagacaatcggcagcgtaggaaaaaagccgaagggagagggcacagtcacaccgcttcaggcattgacctcagccctcagttcaacgatcggtgcagcgaacattgtcggtgtgcccgccgctattatgtttggaggaccaggagcggttttttggatgtggcttattgccttatttgccatggcgattaagttttctgaaagtgttcttgctgttcattacagagaaaaaaatgagcagggtgaatacgtcgggggaccgatgtattacataacaaaagggctccgcatgaaatggctcggcgtattcttctctgttgcgctgattgtggagctgatcccgagcattatggttcagggaaattcggtttcagtctcgcttgccgagacgttttctttcaataaaatatacgcaggaatcggaattgcatttttgattgggttagtggtgataggaggggtaaagcggatcggaaaagtaacagagtttgtcgtacctcttatggcaggggcatacgcgggagccggtctcctgattgttctcatgaatctatcatcagtgccggcgtttttctctctcatcttttcaaatgcgtttacctcttcttcagcagttggagggttcgcaggtgctgcgttggcggaaaccgttcgctggggatttgcccgcgggctgtattctaatgaagccgggatgggaacagccccgattgcacatgcggcagcaatgactgatcatcctgtgcggcaagggttttggtctgtgatcggcattgtcattgacaccttgatcatctgcacgaccaccgcttttgtcgttcttgcatctggtgtctggacagggaagaacgcctcaattgacccggcagcactgacgacggctgcatttcagcattatttcggttctggcggagggtacttcgtttcggtttccctagtcttctttgtcgtatcaaccattatggttgtcattttttacggcgtaaagcaagctgaatttctgttcgggcggctggcaggacacgtgattaaattcgtttatttagcggctattatcataggtgccgcaggcggagcaaaagccatttggggctttttggacttagcattggcttttattctcgtcccaaatgtgattgcgctgttgttattgagcagaaaggtaaaagcgctgtacaccgaattctttacatctgaacagtactacctgaaagatataagaaaaacaaaacagaatcctgtttatcaaacaaaagaagctaaaaactcctagtgctttgctttggcgccgaacaacgctttgctttttatgatcaaataaatgagtaaaggcagcaaaagagaaatcactacattaatgattggtttgattctgttaaagtcgattagctgatttgtatttaaaaagaaccaaaagctgcatacgactgagaacatgccggttggtgtatacatggctttcgggtcgatttttgagtgtaaaaacgaaaggccgtataccacgatatatagggaacctgctatcttcaccataatgaccggaatccaaaaagccgcgatgaccaggtctgagcgatccagaaaatccgtaatgcggatctgcctgatgaccatataagcaggatcaaagaaagtagatgtcaggttgggaccaaagacagaaattgaagaaaataacatcacggccagcaataaagcacccagcagtatcgcgaaaatggtgtattttagcgggacgctctggtttgagaagagaagcggaaggataatcaattcccccattgtcccaaacgcgtaatagcctgattgaagatatgggattagaccttcaaaaacaggcgtcaagttttgaagctcaatttgtgtggccagcgtgaatggaaggaacaagaccagggtgccgaatggaaataagaatatctgcgccattctggtcaatgtttcttttccctctctggcaatacagatcgccacaaagataataacaccgcccagaacagccattggtgttctcgggagaaataaaatgttaatcaaattgatgaaaaaacgtatatcatgagcattgattaacaggaaatacaaagaaaacagtaaaatgataatccggcctgcgattggtgaggaatcgctcagcagctcatagatatttttatcctgatgctttttcatcagcctatgcatgagccagagtgccggaatcacgatgacaacgccgaggatgtagctgtgccaggcattttgttttgctgattcgatcatgagaatcggagcatgctttaatccgaccgctaacgtatacagagctccgaaaaataatccttggtatgcagaggtcttgtccataaagcacatcctttctgtcatgttcaaaacggaatatatttaaacaggtgccccagccgcggaagcaggggattcactctcatataaatccatagaaaagcacttcctgcaattagcaggctgaaggcccattttgttagattgttagcggaacgaaaattcttccattcatatgcgtatatggcaatgcacacaatcaatgtctgtacgatatagctgatcatgctgacgcacctccattaatggctgatcgttttgtataggacaccgccctgctcaatcgtcacaattgggacgacgtgaacctccatatccttatatacctcttcccattcctttttcagcagattcttcgtggttgccgtgcttctgatggtcctgtcttgaaagccggccgggtccgcctttagcttttgcaaacgatgaacggtgctgatcacgtccttctttatggttctgtttaatgctttttgaatgatgtaatactggtcagtttctctcgtctcataggttgattggttttccataataattcctttggctctgatctcgattgtcattgacagctttccgtttttttcagcggcatgaaaggatgcattggacttttgaagctgaatggatgcttgtcccatttgattcggcaggtctactatgaattctggctggcgggcttgattaagcaacatcagggctgctgtcatgtgttcatctttgaaaatatccatcaatctgtcctttttaaagatcgcaagcccgtcaattttcaaattagatttgcctttccctccaggttttgttttagatgcagagatgaccggtgcatacggatcactgcctatttctactagatcagacatgaatctgcttaaaaaaacggggcggctcgttgcgataatggccagctcccgaatcatttccgccggaaactgttcaagctgaacatcggtgtttaaaatgtcccgcgcttctccccggctgactaaaatgagcgccgttaatctgttctgcggatttcgcgttaaaatatcaaagactggggcaacgccgtctctcgccatatcctctccaataatgactgtacgtctgtgggacgtattgattgtccgtgacaaggaggtttgcagcttgttgttcgcttctctgatcgtagtgccggaagctgaatcaacataccatgtttttgaaccggcagttccgccgccgccccctgtttgtccgcctaattgaccgaccaagggaatctgcatggccactcgatactgatcttttttcttatcaatggctgagctgacaacaaatgcaatgtcattgatttctgtccggtcccagcaccccgttagaaggatacaaatgagaagcggcaaaacacacttatatattgttttcttcatcttttgggtcctctcttttcgctcccttctgtccgttgccgcgcgaatacgtgcccggccttctggtcatcgtccaccaaggcgccctgacaaaaatatcttttacttcatctcgtttaaacggagaaatcccggataaataaggaatgccgaaagattgcagcttgcataaatgaagcactaagataatcgtgccgagcataatgccgaatatcccaaaaatacttgccaaaaacataagcgggaaacgaagcatcctgatggagatagctaagttaaaccgcggaattgtaaatgacgcgatccctgttaacgatacgatgatcaccatgggggcagacacaattcccgcttcaacagcggctgtcccaatgactagggccccgagaatactgacggtctggccgatggttttcggcaggcgcactcccgcctcacggagagcctcaaaagaaatttccataatcaatgcttctatgatggcggggaaaggaatcggttcacgcgcggaggccacactgaacattaagtttgtcggcattaagtcctgatggtatgtaataacggcaacataaatagccggcaaatataaagcaacgaataaaaacatatagcgaagccagcggattaagttagacatcaaataacgctcatagtaatcttcactggcctgcataagctgccaaaacgtaatcgggcctgttaagacaaagggcgtattatctgtgaaaatggcaaatcggccttcgagaagctgggcggcgacggtgtccggcctttctgtgtattgcagctggggaatggcgagtacgtgtcgtcttcgataaattcttcaatatatccgctttctaagacagcatcaatctttatctttttgattcttttttttgctttgtcaatgacctttggatcggcaagcccgtcaatataggccaagacaacatctgttttggtttttgtgccgattttaaatgagatcattttaagctgaaacgttttgactcgaaaccgcacaagagcggtattgaccctgaggctttcagtgaagccctctcttgaccctctgatggtcgattctgttatcggctcttcaatgcttcttctttgtccgccttttatatttaagatcaggccttttgagtgcccgtcggcaaataaaaccgcgttcccctcaatgatggatgcagccactttactcatactcgtttctattgcaacacttgaaattgatagagtattttgcagcgcctcttcatgttcatctatttgatccgtcaaatgcattaagaaagggcggagggcgtgatcctgaatatgttcagattttacaattccttcgatataaacaataaatccgcacagcccgtttccaaagtcaaattgtctaaatacgatgtctgagcagccttctgttaataaggtcagattatcgaggttttccttcaaattgggagagatcggtctgtcctgattgtcttcaagctctttgatgagctgaagcgctttgtcgcgtttattcatagagactcaccctgctttttaatgtcacaataagtgcttgtgacttttagggtaaccttgtctgtttcatatattccagactaggatgaaagcgctataaaaaagtgttgactacctgtatatacaggaatacaatatgattataagttgtatatacaagttataaaaacggatacggaggggttggcatgggggaactgaacaaatcggcacgtcagattgtcgaagcagtcggcggtgctgaaaatattgcagcggcaactcattgtgttacacgtttgcgttttgctttaatagatgaaagcaaggttgaccaagagatgcttgatcaaattgatgtggtaaagggatcattctcgacaaacggacagtttcaggtcgtaatcggccagggaactgtcaacaaagtatatgctgaactggtcaaggaaacggggattggcgagtcaacaaaggatgaagtgaagaaggcctcagaaaaaaatatgaatcctttgcagcgtgctgtgaaaacgcttgcagatatttttattccaatattgcctgcgattgtcacggcgggtcttttaatggggatcaataacattttaacggcggaaggcattttcttcagcacaaaatcgattgtgcaggtttatccgcagtgggcggatcttgctaatatgattaacctgattgcaggcacggcctttacgtttttgcctgcgttaatcggatggtctgccgtcaagcggttcggcggcaatccgcttctcggcattgtgctcggagttatgctcgtgcatcctgatttgctgaatgcgtggggatatggcgcggcagaacaaagcggagagatcccggtatggaatctattcggcctagaggtgcagaaagtcggctatcagggtcaggtgctcccaattttgcttgcttcttatatgctggcgaagattgaggtatttttaacaaaacgcacacctgagggcatacagctgctcgttgtcgcaccaattacgcttctcttaacaggatttgcctcttttatcattatcggcccgattacatttgcgatcggtaatgtactgacttcagggcttatctcggtgtttggttcttttgccgcactgggcggtctgttatatggcggtttctactcagcgctcgtgattaccggtatgcatcacacgtttcttgcagtcgacctgcagctcatcggttcaaagctcggcggcacctttttatggccgatgctggcgctttctaatatcgcacaaggttcggcagctctggccatgatgtttatcgtgaaggatgagaaacaaaaaggcctctccctcacatcagggatttctgcttatcttggcattacagagcctgccatctttggggtaaatctgcgatacagattcccgtttatcattgcaatggtcagctctggcctggccggaatgtatatttcttctcaaggtgtgctggcaagctccgtcggtgtcggcggcgtgccggggattttctcaatcatgagccagtactggggcgcgtttgcaatcgggatggctattgtattgatcgtgccgtttgccggaacatacgcgtatgcgagattcaaacataaataacaaatggggagcgggacgtgttgaacgttcccttttcccgttttcaatttaaatatggtggtggaaacagatgaaaacagaacaaacgccatggtggaaaaaagctgtggtttatcaaatttatccgaaaagctttaacgatacgacaggaaacggtgtcggcgatctgaacggcattattgaaaagcttgattacttaaaaacacttcaggtggatgtgctttggctgacgccgatttatgattctccgcagcatgataatgggtacgatattcgtgattattactcgatttatcctgaatacggaacgatggaggattttgagcggctagtgtccgaagcacataaaagagacctgaaagtcgtcatggatcttgttgtcaatcatacgtcaacagagcacaaatggtttcgcgaggcgatctcttcaatagacagcccgtaccgtgatttttatatatggaaagacccacaggaaaacggttctgttccgacgaactgggaatcgaaattcggcggctcggcatgggagcttgacgaagcatcgggccaatactatttgcatctgtttgatgtgacgcaggctgatttgaattgggaaaatgaagaggtcagaaagcatgtctatgacatgatgcatttttggtttgaaaagggaatagacggctttaggcttgatgtcatcaacctgatttctaaagatcagcgctttccgaatgcggaggaaggcgacggccgctctttttacactgacgggccgcgggtgcacgaatttctgcatgaaatgaacgaaaaggtgttttcacattacgacagcatgacggtcggtgagatgtcttcaacaaccgtagaccactgcatccggtatacgaatcctgacaataaagaacttgatatgacattcagcttccatcatctcaaggttgactatcctaacggcgaaaaatgggccttggcgccgtttgattttttgaagctgaaggagatcctatctgactggcaaacggggatgcacgcaggaggaggatggaacgctctgttctggtgcaatcatgatcagccgcgcgttgtatcaagatatggagatgatggcgcatatagggtgaaatcggcgaaaatgcttgctacggccattcatatgatgcagggcacgccttatatttatcagggcgaggagctggggatgacgaatccgaagtttactgacataagctcctatcgggatgtcgaatcgctgaacatgtatcacgcctttaaggataaaggaatggctgatcaagagatcacagccattttacaggcgaaatcccgtgacaattccagaacccccgttcagtgggatgctacggaaaatggtggttttacaacgggcacaccatggataccggttgcaggaaattaccgggaaatcaatgctgaagcggcgctgagggatcagaattcggtgttttaccattatcaaaaattgattcagattcgcaaaatgtatgacattgtgacagagggtacgtatgagataatcgcaaaggatgacccgaacatttttgcgtatctcagacacggcagcaatgaaaagctgctcgtgatcaataatttttacgggacagaggcgacctttacactgccggactctttagcgcctgacgaatggaaggcagaggtgctgttgacgaacgatgaagcaagggaagggcttcagaacatgacgcttcgcccgtatgagtccattgtttatcgtttaacgaaaccgtgttaaactaagctgggtggtccataatgaaggtgaataaattcatcacaatttataaagacatcgcacagcaaattgaaggcggccgatggaaagcggaggagattcttccgtctgaacatgagttgaccgcacagtacggtacatcaagagaaacggtccgaaaggcgcttcatatgctcgcgcaaaacggttatatccagaaaatcaggggaaaaggctccgtcgtgctcaattgtgaaaaaatgcagtttcccgtttcgggccttgtcagcttcaaggagctcgcgcaaacgcttggcaaagaaacgaaaacaactgtacacaaattcgggctggagcctccgtcagagctgatccaaaaacagctccgggccaatctggatgacgacatctgggaagtcatcaggtctagaaagattgacggggaacatgtgattttggacaaggattactttttcagaaagcatgtccctcacctgacgaaagaaatttgtgaagactccatatatgaatatatagaaggagagctcggtctttcgatcagttacgcccaaaaagaaattgtcgccgagccgtgtacggacgaggacagagagctgctcgatttacgcggctatgaccatatggtcgtggtgagaaactacgtctttttggaggataccagtttgtttcaatatacggaaagcagacaccgtctcgacaaattccgatttgttgattttgcgcggcgggggaaatgagagaggcgcctgcctgcggcagcgcgcttttttgtttggtatcaaaattgatactatccaacaaaaatgtgcgtacttttactttttatcataatggctacaatagagatgagagtaacctaaaggagaggtgttttacatggcagatctaaagaaacaaattctggatgcatacaatttcaggcatgcgactaaggaatttgacccgaataaaaaagtgtcagacagcgattttgaatttattttagaaacaggaagactgtctccgagctcactcggccttgagccttggaaatttgtcgtcgtccaaaatccggagttccgcgagaagcttcgtgaatacacatggggcgcgcaaaagcagctgccgaccgcaagccatttcgtcctgattcttgcgcgtacagcgaaggatatcaaatataatgcggactacatcaaacgtcatttaaaagaagtaaaacaaatgccgcaagacgtgtacgaaggctatttaagcaaaacagaagaattccagaaaaacgatttgcatttgcttgaaagtgacagaacattgtttgactgggcatcaaaacaaacctatatcgcgcttggcaacatgatgactgccgctgcgcaaatcggtgttgattcctgcccgatagaaggcttccagtacgatcacattcaccgtattcttgaagaagaaggccttctggaaaacggaagcttcgatatttctgtgatggtggcatttggctaccgagtgagagaccctcgtccgaaaacaagatctgctgttgaagatgttgtgaagtgggtttaaataaagaaagctgctcgcttagcgagcagctctttttatgcctgattcgctctattctgttttctcctctgatgtaagtacattgcggtgccgagtgcgctgatcagaaatccggccaacaggatcgagtacatggatgtggctgtgtccggaagcaggccgccagccggaccgtctgttcctgatccgcccgaaccgtttcctccagagccgttagtcggttgagtgccgggaggcgcatcatttcctccgtttccgtcagttggctgttttccgcctggtttgtcggagccgccgccatgattgccgtcatcaccgcctgtcggttgatctgacgggaatgcaggcggtttgttgttctctccggaatttaagatcgtgtattcgctgaagtggtttgtatatcctgtcaccatatcatcgtcaactgatccgtgatctgtctttatgaaagctttctttttcctgtcgacatgataaatggcagggttatgggcttcttcaatatcaaacatgcgaagcgaaagctgaacgggctccttgaatgattttatttcttttcctttttgcttcactgtaaagtcatatacatctgccagtgacacatccaattctcccgtcgacttgattccgattgcagtgtctgctgatttaaggttcgccattggcatcttcatgctgtaccagtagttgaacaccgtcaatgaaggatctgattctctttctttcaaaagtttgacctgatctttcttcattttaagattgataggcttctcttgagatccttcatgtgttccataatagacaaacggcgtgttggcatttttagcgtaaatcgcaaatttgtcttcatcaagtgtccagctgccgtcctcctgctttgtcggcaggaatacttctttgatccgtccttcaagcttaggagagaccttgtttcctagttttttcagctgttcggtgaaaatctcataatcaacgtagccaaggtcttcaccatgggaggcttctgtaaagacagagtatccgtctcctccggcaccgacaaaattatttgttgccacgcggtaggtatcatctgtatttatagcaactttgtctccgttaggcgattcaattttcacttctaacacacggtgtccaggttcgttgtttaatgtaaaggtatattcgattccggccacctgagggaaagcgccgccgccattttccacattgcttaagccttgttcaagggcttctttaatttgttttccggttaaatcggccacgtaaagcgtattgccgaacggcatcacgttgagcacctcgccgagtgtgatatcacctttgtcaatgccggctctgatgccgccgccatttgttatcgctattctggcgccggctgcttctttcgcttttgccagcataccgtccgcaatgaagtttccgagatttgtttccttcgtgcgcacatgctcacgctggccgtcaagcgccacatccgtgtagccgactttttcattttttacgtcttctaattcatttttgaactgatcgagctcttgttttgcttctgggttttcttctgtatgttcatcaattggcagcacgctcagatttgatttatctgtttgcacaacgcctttttcatcaaacgcgacatcaacgcgccccaagaattggccgtattcttttgcctgcgccacgatcgtcggttcttcgctgtttacgacctccattttgtcaacgagggtgtgagtgtgtccgccgatgatcaagtcaatgccttttacttttttggctagctcaagatcacggttatgaccgatatgggttaaagcaataattttatttacctgttcttcttcctgaatcgctttgacggtgttttgtgctgtttcaaaggcatcattgaatacgatgcttttgcccgggcttgaggtggtggccgtatcttccgttgtcaggccgaatacggcgactttctccccgtcaacgtctaacagaatgtaaggatggatgccggcctctttcttttcacctgcggtaaaggtttgcggttttttgacaaatgatttcagtttgggctcatttgacacatctacgtttgcgctgacaatcggaaattccggcgcttcaaagtgatagcggttcgccggatcaacggtcgcgctgtttccgcttagaaaatcagaaagcactgtcgggcctttgtcaaattcatgatttccgaaggtcatggcgtcatagcccatcatgttcatcattttcagatcggccaaaccgttccattttgtaaaatacagatcgccggaaaacacatctcccgcatcaaggagaatgttgtgatttgtttcgctgcgtacttcgttgattttcgtcattcgtctcgctgcatcatcgagatgtgcgtgcgtatcattggtgtgcatgacggtcagatcccacagtccgtctttaggaggatctggatttgaatcatcatcgaattgcagcttatacacaccatagccttcattcgcagacttgcctacataagcgacgtcgtctgctttatcggcaaatggcttggccaaaagcgaggattcaaacgtcagattcgtgccggaaacaggcgcgattgaccagttgttgtctgcctttggattgactgttttttgttcaataatgtaatccatcagcacctgcctattttcaactgcagagccgtggacaattttatcgcttgtcagatgagggaacccgccgcctccggacgcacgatagttattggtgactacgagaaattcctggcttgggctgatcggcttgccttcataggaaaggttgatgatccgggatgaatccgcattgatcacttttccgttctcattgtatttagccggttttgtcacatcgacctgatatgtgacaccgtcaatcacgtcaaaattataggagcggaaattctcgttcagcaaggcctgatcgccgcctttggctggatcaatttggttgaattggcctgctgacatctccagccagtccttcacttcgctgcctgtcagcttgacgatttgaacagtattatcgtaaaggtacaagtcaccgacatttttaatcgcaagatctccggctggaatgtttgtataataattggctccgtttctgccgcctgctttaaacggcgcccccgcagacaaaattggaaggttcttgtactcagtatccttcatttctttttgggcataccatttttgcgcgtcagtcacgatctgaatggaaggatcatctttgacctgtgcaaagaagctgttaatatctgcttcggttttgccgactggctttcggacatactccagtgtgttttggtgtgtttgctgaatggtgtttgtaacggtttcgtttcttgatgtgacgttgccagcaatagattcaatacttcctttggaatctgctaccttccatgagccgtccgccttttcaagcttgaggtcaatcacgcctaaatatttgccccagctgcttggcatgacgacaggaatgccgttaattgttcccttttccacattgaactgagcaacacccgcatactcggcggaaggaaagagtccgtgctgatggcccgagataatcgcgtcaatgcctttcgttttggtggcaaggtcaaatacggcgttttctgcacctgatgattgtgactgcttttcaatgccggtgtgggcgagggcaataatgacatctgcgccttccgccttcattttcgggattgtttcattggcggattctacgatatcctgcacctgaacctgcccctcgagattctttttgtcccatgtcatgatttgcggcgggacaaagcctatgtaaccgacttttactttctgctcattaccgttttcatcaatgagagttttttcattaatcacatacggcgtataacggttttcgccgctagttgttttgacgttggcatttacaatcgggaaatcggctcctttgattgtgccgtcgagaaagtcgagcccgtagttgaattcatgattgccaagcgttccggcgtcgtatttcagcgcattcatgacgctgataatcggatgggttttcgtgccggagataatgtcgtctttttgatatttcaccgcgtattcacccagcggattcccttgaatcaagtcgccgttatccacaagcagggtgttagggttttgctcgcggtgcttttggatcaattgcgctgttctcgccagaccgaaatccgccgtttctttgtcgctgtagtaatcgtaatccatcatgttggcatgaatatcagtcgtagccaaaatactcagatgcacctgaggagccgcgctttcttctgcatgaatgggtggtgttgggaggattaggctaagtatcataattgggggcaaaagaatacggagaatgttttcgacgtgtgttcgtcttttctgtattctcaccagttctccacctttcaacgaaatttgtgttacagctcctattgtaagaatattttgtaactatttgtaggtgtttctttatgattattgtaaaagggagaaaaatgagtactatgtagcagcttcaagcgacaaatactgggtatttatgcttatcgtttgtccatattcgcaaaatgtttattttagtgtggctggggtagagtgttttatgtagacatataaagcgggaggttatgaaccatggggaaaaaattgcagttgttttgacagattactttgaggacagcgagtacactgagcctgcgaaagcctttaaagaagcgggacatgaactgactgtcatcgaaaatgaaaaaggaaaaacagtaaaaggcaagcagggaaaagcggaagtgacggttgacgcgtccattgacgacgtaaacccttcagactttgatgcgcttttgattcccggaggattttcaccagaccagcttcgcgctgacgatcgtttcgtccaatttacaaaagcgtttatgactgacaaaaaaccggtattcgccatttgccacggcccgcagcttttaatcaatgcgaaagcgctcgacggccgaaaagcgacgggctatacgtccattcgtgttgacatggaaaacgccggtgccgacgttgtggacaaggaagtggttgtttgccaggatcaattggtcactagccgcacaccggaagatataccggcatttaaccgcgagtcattggcattgcttgagaaataagaaaaaacggacgctcttgggcgtccgttttttgttgcttaggcttgagcacctgtcagtttcttgtacctgtaatacaagaaagcagctgcagccgttccgatgaccgcaatgccgaagtcgaatatgaaaatatgagcgatgcccccgcttttgcgataagccctgttgcaatcggcagcagaatcgatgcaagacttgaagcggtcgctacaattccggtaacggttccttttcgcttccagaaaagctctgtcattaacgtaatggtaatttgaaacacacccgcagttgaaaagcctaagaaaaaggcagtgatgtccagcacaactgggatatgaacggtcagcatgactgcgagcgtacataaagtaataataggatataagagcgttatgaagacaggtttgacccatctgttcagcaaaacggctaataataaaacagatgccagagatcctatactataatagctcagcaattgaacagatgctgattcagctaaaccggctgccttttgcgcgtagctcgggagccagatttgagaaaccgtaaataaagccgtggatgtaaaaccgatgataatcagtgcagtgccttctttctgaaaaacgggttcagacaagaaaacgggagattcctgttggccgctattagttggtttcttatgttttttaggaaacgaaagcgttgataaataaataatattcaggagatagaccgctgccggcagataaaaagcaaatccgtaaaacatgctgtggtctgataaaaatgtgatcaaaagcggcaaaagtgcggccccgacagacataaaggctttgaccaagacattcgccgaaccggaagcagacggaaagagttcggttagggccggatatgttccggcatccatcgctgaatttgcgactccggctaataaggcgaacacaaacgccagctcatagctcggtgataaaggaataccgactaaaaagacggccataattcccgcagaagcgacaacaagcggctttctgccgattttatctgatagaacgccggaaatgccgtatgtcagcagtttgccaaacccgatagcggcaatgacataactgatgccggtcggatcggtattccactgttttgttaatgaagacatattggatgcgagaatgatgttgaccatccccagaaagaagtagttgatatacattccggatgctgttttgatagatgtcgtttgcatgcttgtactccttcaaatcttattcgaacactttgctgttttggtttggggaaatgataaaaaagactcgccgagtttccggccagtctccattatttacgaagcgaggctaattcttgagcaatcgcctgcatttcacttgggctgaatgattcttttttcatcaccattctgtgaaggtacgtgaggtcttcaatcttctcatcactgaaatcctccgctttgattacgccgacgttcagcatgttcagcttttgggaaatctcttcaatcatttgagttaatgtttctgtatttgggctggacaaatggttccatcctttctatgcgcaatataggtatgttttattctaacagaattccatcagaaaaaaaccctattctaaaagcaggctgttcattccaaaaaagtgaagacatcagttgaaaagaaaatgaacatcctactaagatattcatgaaggtttctttttagagaaataggggcaaagaatagggaggttggacaatatgataagcgtgttatttgtttgtttaggaaacatttgccggtctccgatggcggaagcgatttttcgggaccttgcagccaaaaaggattagaggagaaaatcaaggcggactcagcgggaatcggcggctggcacatcggcaatccgccgcatgagggaacgcaggagatattgcgcagagaaggaatcagctttgatggcatgctggcgcgtcaagtcagcgaacaggatctggccgattttgattacatcattgcaatggatgcagaaaatatcggaagtctcagaagcatggcgggatttaaaaacacctcacatatcaaaaggcttttggactatgttgaagattcagatcttgccgacgttcccgatccttactacacagggaattttgaagaagtctgccaattaatcaaatcgggctgtgagcatctgcttgcgtctattcaaaaagaaaaacaattgtgagtgaaaggagaatttgcatgaacaacgaacgtttaatgctgaaagggatatttctcggagctgcggcaggcgcggcgttatcactgctccataagccgacaagacaggcgtgcggcatgagatggctgacatgcaagcataaactttcactgtataaaagcaatccggagctgttaaaaaacactgtcatcacaaaagtggatgaggccaaaaagctcgcccaaacgctttcaaaggaagtcgactttgtgaaccagcaggtgaaagagctgaagaaaacaacgccgcaagtgatggaactcgtgcaagaaacgaaaaagcatttttcaaaaaaatgatcaaacatgcgaggtgagacgacatgagttttttgaaagagcttttcagcagatacacccttcatgaaggacaaagtaaatcagcggagctggcgtatttttttctattgtcactgtttccgtttttgatttttatgctgacgctcaccgcgtatcttccgctttctaccgatgatgttttaggagtcatagaacaatatgctcccgccagtgcgatgtctctcgttgaatccattacccatcaaaccttaaataatcgaaatggcggtttgctgtcattcgggattatcgccgcattatggtctgcgtctaatggaatgaacgcgatcgtccggtcgctgaaccacgcgtatgatgtggaagaaaaccgctcttttatcattgttcgtctaacctctatttttttgacgattgccatggtatttacgattttagtggctttgcttctgccggtatttggccgggagattggaaggctcgcttctgactttgtcggcgcgtcggatctgtttttatccgtctgggccgccattcgctggggtgtcagcccgcttgtgcttttgattgttttttccgcgctgtatgtgattgcgccgaacaaaaagctgtctctccggtttgtcatgccgggtgcggtctttgcgaccatcggctggatcgttgtcagcacattgttttcattttacgtcagcacgtttgcgaactatagcgctacttacgggagcatcggggaatcatcgttctgatgatttggttttacttgagcggcattttaattatcctaggcggagaaatcaacgctcttttacataaacgtaaaaagcttcctgatgaaaatccctaccattagcgcaccctataaacgaacttcggttcaaaaagaagtcggggggatatcgtgatgaccaagcatacgaaaaaaggcggaagccataacaaacaaaattcgaaaagcaaatcgagccataaaacaagcggaagcgccaacggacaaaacggctaccattagcataaaagcctcctgacatgatgtcgggaggctttttgattaagaagatgaagaataggtttcagccggtgaccagcttttcggtttgcccagcacaagggccagccacacagcgctaagcgtgagagtaatgaagtagaacaagtttgcgctttcaaatgtctgcatataccagccgccggcaaccgggccgaggatgctgccgagactgaaggtaatgccgcaaagcaggtttcccgccggcaggaggtggggcggaagaagatctgtcatatagctgatgccaagtgtaaaggttgatcctactgccattcctgcaataaaaaagcagccgccgatcacgtaaggcgaaggaaatacaccggctatgaaaaagcaaagagccccagtcagtaaaatcaccagcagcacattccgcctgccgtatttatcgctgaggatgccgagcggaaactgaaaaataatgcttccaatcgcaaatgcgggaaggatgatcgctactgcgtctactgatatccccaaacggagcgcgtacaccggaaagcttccgttcagcgccgtttccagaaagccatagccaaatgtaggcataaaggcaacccacccaaacagcatggcctgataaaatcgcctgaaactattgtctgatttggtttcatgaggactggtttccgggtatgcattttgtagaaagaaaacaaaaagccacgcaaacagactgatgcagccggacacgataaaaggaagcgacggactcagcttgacaagcggcaccatgaacgggcctgcggcaaagccaaggccaaaggaaagcccgtaaatagacaggtttcttccgcgattttgttttgatgacatggaggtcacccacgtttgcgtagaaaagtgaagcatgtggtcgccgattccaatgaacaggcgaagcaggaaccagacccaaactgactgaagccaaataaatccgaataagcttaaaatgacaatgcttccgcccatgacgatcagcggcttgaacccgagctttctgagcggcgcttccataaacggcgaagccaaaagcacaccgatatacagcccggtcgcgtgcaggccgttgatagcagcggattctccatttgtttcaaaaatgattgaaatgacaggcagcagcatgccttgtgaaaacccggaaatggatacgagcaagacaaggataaagaaatgaaatcgtgacatcgtgtcagttctccttatgtggaatctatgttgatcgtacaatgttttccaaaagcaggcaacctgaaaaaagcctatatcaagctaaacatttgccctcgtgtaatcatgaaggtttttgtgaagaataaaaataaaacaagtcataaaaaaggagctatttcaccatgaatcgtatcttttttattttagtggcggccggtgttccgctttctgtgattggcagtttgatgcattggccttccgcggttctatttgccgtttattgcgtgacgattatcgcgcttgcaagctatatggggagggcgacagaatcactgtccatcattgcaggaccgcgtatcggcggtttgttgaatgcaaccttcgggaatgcggtggagctgattatttccctttttgcattaaaagaaggcctgacaggaatcgtgcttgcctctttaaccggttcagtgctggggaacctgctgctggtagcgggcctatcgttttttgtcggcggtttaaaatataagcggcaggaatttaatatccatgatgcccgccataactccgggcttctgatttttgccatcattgtcgcctttgtgattccggaggtattctctgttggtatgggaaacgccagcaagctcaatttaagcatcggcatcagcatcattatgattctgttgtatgtggcggcgctgtactttaaacttgtcacgcatcggggcgtttatcagccgaataatgccgctcagactgaagaagaggaagagccggaatggtcagggaaggttgcgacgattgtcttgtttgcggcaacgattgtggttgcatacatatccgaaaacctggtacatacctttcactcggttgctgaacagttcgggtggagcgagctgtttatcggggtcatcatcgtggcgattgtaggaaatgcggcggagcacgcgtcagcgattattatggccttcaaaaataaaatggacattgcggttgaaattgcagtcggctctacgctgcagatcgctatgtttgtcgcaccggttctcgtcatctgttctatcttttttccgacaagcatgccgcttgtttttacattgcctgagctcgtcgcgatggtatcagcggttctcttgatgatcgcgatttcgaatgacggggattccaactggtttgaaggggcgacactgcttgctgcatatgtcattatggcgatcggctttttccttctttaacctgaaaaaataatggataacaacaaagcgggatgaaaagactaagggaaaatgccatagaaagagtgatatgatgaaaaagctatttcattccacacttatcgtgttgttattctttagttttttcggcgttcagcccatccacgcgaaaaagcagtttaaggttcctaattctgtcgcaagcatttcaaaggaaaacacgtatccgaatgcttcacaggatcagccaatgcttcagccgagcaagctggcaaaggaattgctcgatcattctgaggtgaagattgaaaatccgcatctcatcaaaatgctgaatgaatccaacatatccggcacaccgcttgcagtagggtaccgggcgacaatatttctcgggaaatgggcgctaggctatgaatcaaatgaaacagtcgcaaactgggaatataaaaaaatcaatacaaaccgtgcggataaccgcggcgggaaagaaacggctgaaatgcattatgcccaggaacagcagtacagagtgaagggcggcctgacagctaaagttccaaatgctgaagatgtcaaaagcatgatgatgcaaaaagcaatgaagaaaacgaaccttccgcttgcatttgagacggtcattggggctggcacaaaacgggatcagatttataaagtcgctcctaaaaaaatcggttatttacatgcatatgcaccggctgtgaatgaaaaaggaaaagtgacttacggagaagtgtacttagtgctgaaaggaaataaacgaaaactcgtcgtgaaaaatgtcacgtcacagggcatcggcgcgtggattccggttcaagatcatgtcacatttggctttcagctttcctcactgccaagataaataaaaaactgattccaactcggaatcagtttttttgtttattgggttctctcgattcggaccgcttcctcaagcatttgcacattgttttggtagagctggcgaacgagaacccgtcttactgcaaggctggcactgaaataatcatcatctttcaccatgcctttaaccgtaaattcgacgccgcgattgattttattcaatgcggtgatgccgtggatttgaaatggttctgtcggattgccgaattcatcccgcttcaatgaatcacgaagctcttcattcagcatgtcacatgcctcttccaacacgctgtacacgcggtccggatcttctttaaagctgataagaaaggattcggtaatccgcataaaatcaatattatagttctctatttgtctgacctcgccgttgctgatggtgagcagcttcccgctccattcccggatttgcagcgagcggaggccgatttcctccactgttccgttgaacaagttgttgacggtgacataatcgcctttgtgcagctggcgttcatatattaagaacacaccagccagcacatctttgatcagcgattgggcgccaaaaccgatcacgatacctgctacgcccgccccggccaatatcttgccgaaatcatgcacaaataaagaaataacataaaagataaaaccaattgtcgccgtatactgggtgacagaacggacaaggctttcaatcgttttttcctttttttcttcaataaaatccgtccgtttaaaaaatagctgtaccagccggttgatgataaagacaccgatccaaaggataacggcaacgaggagaatatcgacgattttattttgaaaaatctccgtaagtgtttctttcatccgcatctaactcctggcttgacgttttgtgaagtctgtatcctgataataactgtttttgacaagaacattcggtccgaggcaccggacattcgggcagtggcaacttagttccttcgcaagcttggtctctctccacttttcataggcggaagggaggctgtccgtctgaatgttgccaagcggcggggtatcaccgaaatcggtcacgataatgtttccatcgaaaatgttcacattcaggcgggatcggccgtcagggtcatttcgcactgtgacgtttttcgccgcgcgaagccggcgaagcagcttttggtcgtcttcgtccggactgcaggcataaaacggcagcgttccgaacagcatccacgtattttcatcacgaatatccagcaagcggtgaatggcctgtctcatctctttcaggctgagggattcaagagcgcttgcgaaatcgcttggatacattgggtggacctcgtgacgctgacatttcatatcttctgtgatttggcggtgaatatgctcaatatgcggaagagttcgtttgttcagcatcgtttccgcagataccattactccggcatccacgagcgtgcggctgttttcgatcattttttcaaaatagcgcgcgcgctgttcgaaggtcggttttctgtccatcatggcaaagccgatttcagcaaaatcttcaactgtaccccagttatgagaaatatgtagcacatcgagatacggaatgatccattcgtaccgctcgatgtcgagggtcagatttgaattaatttgtgtccgcacaccccgttcatgggcatatttcaataaaggaacaacatattcttttactgatttcaacgaaagcatcggctctccgcctgtgatgctgatggatctgaggcgcgggatttcctccagccgttttaacagaagatctattggcagagcattcgggtctttaggctgcaatgtatagcctacagcacaatgctcgcatctcatattgcacagtgtcgtcgttgtgaattcaacgtttgtcagctgcatgtctccgtattggtcaacatccatataggcttcccaagggtcaaactcgggcgtaatcggacgcagcttcgtgttttgtgtcatgactatctaactcctttataaatgggcatactaacgctgccaacagttaattttagacctgatttgccaagatcgcaagtagcgcggcgattgaaaaacggcaaaaaatgagctaccataataaaaaatgaatggaggaacagaatggggaacgccgtaaacaataaagatcagcagattgattatttaaagaacagacttgacatgtttatgaacgtcatcgattcattagaccctgaagcaaccgacgttgaagatatagacaggcttatcagcatgcttgatgacctggaagccaaatacgaacgttttaaaaaagattgggaataaaaccgcgcgcccgccgcggtttttttattggcataaagcaacagtataaaacaaagcccctatctgtaaaataagaaaaaatgcagaaggagcgctggccatgaagtggatgtgttcaatatgctgcgccgccgtattgcttgccggaggtgcagcacaggcggaagcggtgccgaatgagccgattaattggggctttaaacgaagtgtcaatcatcagccgccagatgccgggaagcagctgaacagtttaattgaaaaatatgacgcgttttatttagggaatacaaaggaaaaaacgatttacttaacgtttgataacggatatgaaaatggctatacgccaaaagtgcttgatgtcttaaaaaaacatcgcgtaacaggaacgttttttgtcaccgggcatttcgtaaaggaccagcctcagctaatcaaacgtatgtcagatgagggccatattatcggcaaccattcctttcaccatccggatttaacgacaaaaacagctgatcagattcaggatgaacttgattcagtcaacgaagaggtttataaaattacgggaaagcaggacaatctgtacttgcgtccgccgcgcggcgtgttcagtgagtacgtactgaaagaaacgaaacgcctcggctatcaaaccgttttctggtcggtcgcttttgttgattggaaaatcaacaaccaaaagggaaagaaatatgcctacgatcatatgatcaagcaggcgcacccgggagccatttacctgcttcacaccgtatcgagggacaatgcagaagcgctggatgatgcgattacagatctgaaaaaacagggctacacttttaaaagcattgatgatctgatgtttgataaagaaatgaggctgccgtctttgtaaaagagaaaaacctctccttaaacggagaggctttttattattttatacatttaatcagtgcggcccagtccagatccccaaagcctttctcaatcccgctttcaaaatggctcttggccagctcggcaagaggaagatttgcagaaacctgttttgcggcggcgagtgccaggttggtatccttcagccctaaagacattttgaagccggccggctcaaatttctgctcggccataatggttccgtaattttgatagactggagaaccaaagagcgcgctggcgatttctaaaaattgtttttgttctaagccgtatttctccatcattaaaaaggattcagataacgcctccagcatggacacaagcaagaaattgatgctgattttggctgcatttgccgtcttgctttcttcgccgacgtcaaatacctgctggctcaggctgtcgagcagaggcttggcagcttgctttgcttccgccggtccggctgttatgatacggagcgcggctttggctgcggcatccggtctgccaagaacaggagcggcgagaaaaaaattgtcctttctctgcatgagctgctgcgagcttttctgagaactcaacactgattgtgctcatcgagatgtgaatgccgttctctgctaatccttcaagcagcccgtcttctccgaatgtcacggtgctgacagaatcatcatctgcaagcattgtgatgacaatatcagcggactttgccgccagccgcggcgtatcagctgcctgtgcgccttctgtgacaagttcttctgtcttttgtttcgtccggttatatacagtcaattcgtagcctgcttgaagaacatttcgggcaatgggctgtcccatattgccgagtccgatgacagcaattttcaatctgatcactccctgaatattttttccattataaacaatatgaacagaatatgcatagcgatcggcttacaacaaaaaagaacagctgctcgctgtcctcatttaaaaatattgaaccatcctttatgtacaaaccaaatcagcatcccgatcacaagcgcggccatcaggccaagtacagcgaaatatccgtatttccaatgcagctccggcataaagtcgaagttcataccgtatacaccggcaataaaggtgagcgggatgaaaatggtcgacacaatcgtcagtgtcatcataatcgcattcatccggtttgagtttagcgtcacgtagctgtcacgcaagtcggacgtcatgtcacggttggattccacaatttcagacaactttaacaaatgatcgtatatgtcactgaagtaggctttcgtttcccgctgctctttcacatggtcaaggcttaaaatccggtagagcaaatcacgcatcgggataatcgtccgtctcaaatgcaataggtctgttctgagatcaaacacctcgttcatcagcgttccatacgttttgtggggacggctttcttcaatttcattcagccggtcttcaattttatacacgagaggaaaatattcatcaacaagctgatccatgatcatataagaaatatgcccgggcccttttttcaatatatccggtgaagcatacaaacgctcccggactttagcgataccgggcgtttcgtgtaaatgaaaggtgacgacaaatttttcgccttgaaagatatcgacttcctccgtctcaagtgtttccttattcagcgcatgaatcacgtaaaaacgatagccgtcataatggtcaagcttcggccgctgcatatgctggaagcaatcctcaatggcaagcgggtgaaaatgaaaaaaatctctcaataacgccgtttccgtatcctccgggccgtaaaaatcaacccagtaccatgcaatatcaggctgttccactcgttcgatcggtatatttttcagcagctgatgctctgttgtgattgcggtaatgttgatcataaacaaccctccacctgccattatatcatgcggtctttatgagaaaagtatacggtactctctgcctaattcaagcggcatgttatactgaacaaaaacggaaaaagggtggatctcatgtggaaggaaaaagtatctgtcacgcctccgtatcattttgaccgcgtgctggacaggctgtctttagaccccctcaatgctgttgatcgagagacgagggaagtccgtgtgccaatcagaaatcaagcgggggacgtatgtattgtaaagatacaggcgttaggccatgcgggtgagcctgagttcctcgtcagcggggaaacggatcagggagaaatgatgaaggaaatcaagcggatttttcaatgggaaaatcatttgcagcacgttctggatcatttttcaaaaacgagcctgtccgccatttttgaagagcatgcagggactccgcttgttctggactacagcgtgtacaactgcatgatgaaatgcattatccaccagcagctcaatctttccttcgcttacacgctaacagaacggtttgttcatgcgtttggcgagcagaaggatggcgtgtggtgctacccaaagccggaaacgattgcagaactcgattatcaggatctgcgtgatctgcaattcagcatgagaaaagcggaatacaccattgatacatcaaggatgatcgcagaaggcacactcagcttgtcagagctgccgcatatggcggatgaagacattatgaagaaactgatcaaaatcaggggtatcggcccgtggaccgtgcaaaatatcctcatgttcggacttggccgtcccaatttattcccgcttgccgatattggcctccagaatgccatcaaacgccactttcagctggacgataagccggcaaaggatgtcatgctggcgatgagcaaggagtgggagccttatttaagctatgcgtctttatatttgtggaggagtatagaataattcatctgacaatgaaggaaatcctgcaaacgtgttatactagaaagatgtgaaaaaaccatttcactttctgccatctgcagaaagctttatatagaaacggagagaacaacgtgaaccaacaaaagaaacaggcgcccgtcgaactgaaggtcggacaaacttttccgctgacgattaagcgtctcggcattaacggagaaggtgtcggctattttaagaaaaaagtcgtcttcgtgcccggcgcgcttcctggcgaagaagttgttgtgcaggccacaaaggtccagccgaagttttcggagggccgcattaagaaaatccgcaaggcatctgagcaccgggtggcaccgccttgccctgtttatgaacaatgcggcggctgtcagcttcagcaccttgcatacagccagcagcttcgggaaaaacgtgatatcgtcattcagtctcttgaacgccatacgaagtttaaagttgaaaacatggaaatcaaagaaacgattggcatggacaacccgtggaattaccgcaataaaagccaattccagatcgggcgctcgcaaagcggcagcatcatcgccggcttatacggtcttgattctcatgacatcgttccgattaaagactgtatcgttcagcatccggcaacgaacaaaacaacaggcatcgtccgccgcattttagaggacttcaatgtgtctgtttataatgaaagaaaacgaaaaggcgacgttcgcacgatcgtgacgagagtcggctttgaaacaggcgaagtgcaggtcgtgcttgtaaccgcaaaagaaacgcttccgcacaaggaagaaatcgtcaaagcgattcaaaagcgattgccagaggtcaaatccattattcagaatgtaaatggtgcgaaaacctcagtgatttttggtgagaaaacaaaaccgctcgccggaaaaacagtgattcaagaagtgctcggcgacgtatcttttgaattgagcgcccgcgctttcttccagctcaatccggaacagaccgtcaagctgtatgatgaagtgaaaaaagcggcgcagctgaccggaaaagaaaaagtcgttgatgcgtattgcggcgtcggcactatcggcatgtgggttgcggacggagcaaaggaagtccgcggcatggacgtcatcaaggaatcaattgacgatgccaagaaaaacgccaaaaaacacggcatggcaaatgccacatacgtaacaggaacagccgagcactggctcccgaaatggacgaaagaaggcttccgcccggacgtcgtcattgtagacccgccaagaacgggctgtgacagcacgttcctggacacgatcaaaaaagtcaaaccgaaacgcttcgtctacgtttcctgcaatccatccacgcttgcgaaggatttgcagacgctgtcgaaggactatcgcgtggactatattcagcctgtcgatatgtttccgcagacggcgcatgttgaagcagtggcgagacttgtattgaaatcgtctaactaaaataaacaatacctaataagacctggatttcggtaaaataaacaattccgatttccgggtctttttcgtgcgcagcccttgtcctaactgtctttccccaattttatcttccttctcattctcggagatctttattttaactggcgaaaagaattgaaaaaacgtgttgaaaagcgggtgaaaaacagcgttatttaaccggagaaatttccttccagtatgtttaaaatacatgagtagaatgatgtaaaataatagatatattttcataatttgtaaaaatatatattgacttgcagttattacgtgtgaaatattgattataggaatataaggaaaggtatggcgtatatcatttcaagagtcattcgatgtaaaaagttgaaacattgtaattaaatgaaagaggtgaaaatgatggccaaccccattttaaaatgaataacgtatgagcactacaacaattaaataatagtgccgagacgataacaactattacagtaatacctacagtggttatacctttaataagtaattattgcgacaatcatgctacataatataatgattttagattgacacttggctaaaaagtattgcagagaaggaaatggataactaaatggataaagtatataaaaaacgaccgttatataaaagaagttggtttcaaacatttttggcatttttagtatctcagctttattttaattttgtagaattaacgggatggggtcctaagtatagagaaatgaatggattcccagcaaacatagttgaactagatttctttcaaacatatctttcattctatgataatccatggtttaatattattactgttttcttgggagttttcactattatacaaataattacagggataacaaaggatattcgaaattaaagcaataacttctgatgccttatttaatgatgaaagaaaatgaacactttcttaattatcttatgagtgaagactgcgacatttagtcagcagtctattttattggttctggatcaggattaccgaattataaccctatacaaatatatagtaggttgccacttgctgcgttggttattttctaaatcatgagcaaatcccaaatgattcagattgaagttcttgaattcttttaaataaggatttattttctcttctcatcctctttactccatgtgattcacaagtggtagcagcttaagtagagttttttttattctcttgagtactcagttataccacccccaactcaatttgctttatctctattagtttttccgcaaatatgatatagagatacggatatggtgtagtgttaaatatcttatcttcaataacagggcaattattttgcgttggtaatatggagaactcatatgatattctatttaggttggaatcctttttatccaaaaagttcaaaagtaaggccactaagaaagacgaaggtcagcgccagttaaccacaatataaaaaatagggtagataatcatcccacgtgaaatgttcaaaatttactatagattgataagaaatgctttcgcatgcgaaaagaagcatggtcagttttttaatattgagatacaggtatagccgtatcccctaatgaaaggatttgatttttgttatgacagaaaatttctggcgtgaattaccacggccattttttgtactggcaccaatggaagatgtgacagatgttgttttccggcatgtagtaagtgaagcaggcagaccggatgtgttttttacagagttcacaaactcagagagctattgccacccggatgggaaggatagcgtgcgcggccgtttgacttttacagaggatgaacagccaattgtggcccatatatggggagataagcctgaaaacttccgtaaaatgagtattggcatggcagagttaggatttaaaggactagatatcaatatgggctgtcctgtgcctaatgtgacacagaacggtaagggaagcggtcttatccgccggccggaagttgcagcagagttaatacaagcagcaaaagcagggggattgcccgtaagcgtaaaaacaagacttggtttcacggatgtagacgaatggcgcgagtggctgacacacattttgaaacaggatattgcgaatctttctattcatctgcgtactagggcagagatgagcaaagtagatgcgcattgggagctcatcccggagattaagaaacttcgtgatgaggtggcaccagatacacttttgacgatcaatggtgatatccctgaccgccaaactggcttaaaacttgctgaacaatacggcgtcgatggaattatgatagggcgcggtatttttacaaatccatttgcctttgaaaaggagccgaaagagcatagcagcaaggaattgcttgatctcttaaggctgcatctggatcttcatgataaatattcagcattagaagcccgtccgtacaagcctcttcctcgcttttttaaaatttatctccgcgggttccgaggggcaagtgaattaagaaatcaatgcatgaacacaaagtcaacagatgaagtgcgtgcattgctcgacgactttgagagaaagtatcttgatgggatagagtaactgcagtgcttgattcaaaaaaggctaacaaaataaagggatttttacaccattcttgactaaaataaacctggattttcggtaaatccgggtcttttttgtacgaagcttttactcagcctgtcttttctctaatttattgtaagaaaataatggtatattgagtggagatatcttataaagggggagaggaaaatgaaacggctatgcatcatcccctgcggcaagaaaaaaatctgggatgtccagcctgatgccgggccggtaagagcagaggacgcttatctcagcccgtttcatcaggcgtgcgagcggtatgcaaaaacatttttcgatgagtgggtgattttgtctgcgaagcacgggttcctccgccctgatgatctcgtttcgggaaattacgatgtcacttttggcaccggtcatccggaaatcatgacagcggacgagctgcgccgtcaatttcacgaaaaaggcttttctgatatcgaagagctagtcatgcttggcggaaaaaaatatcgaagcgttctaaacgccgtcatcggagagcaccagcatatcagctggccgctatcatcttacaaaggcataggctatatgctccaagcgctgaaccgggctgttgaagaaaagcatgaactgtagcacatacatatgaagaaaagagtgtgaacatgaaaaaacttgtgtttggcttgcttgccattgcattattcggatgcggactatatatctatcatgtatggttcggtgatccattttcgaaaaatgctgcagaacagaagctagtctcttatgtgaaacaaacctatcctaagaaagaaatcaagatcacgaatggggtatataacgctaaaacctctgaatatgtattcgaagcaacctcccaatctcatcgctacccaatgtgtacgaagggatttctgcatcctaaagtaacgtgcgatggaattgaagaagcgtatacggaatcagtatcaaaacatgtaaatgaagaagcaacgaaggcaatcgaagcagatctgaaaaaagcggttcctcgacttataaaagctgatgctgctttgagtattgaaaacggacagttcacgttagatacaaaatggaacaaacagctggctgaaaaagcgcctatgagcatgacgattcagttagacgccagcgggttatcaaaaacagatgccgcaaagatggcggaaacggtcagaaaaacgcttaatgaaaagggatatacatactcaaacggcacgatagactgtatgcagaaggacggggacggcggtattggatatgtcaaatattcaattgattttctttcaaaagcagctattcagtcaaacgatgcagaggaactaggaagttaaaaagatttccaaggaaataaatacgtcgatcattgtcaaaggccgggtgatatccggtcttttttgcatgctgtaaaacgagacaaatgaatcagtttgagacaaaacgagacacacgtctcaaactgtctccaaagtgaagacgagaagactggttttacgggctcaaaagactggcacacttcttgcatttataatggtgaaccctaaatagaaggaggcgcacaaaatggaattgttaaaacgagaaggcttatcattaactgaggtaaaagcgctgtggatgtaccaaaagatgctggagatcaggggctttgaagacaaagtgcatgaactgttcgcccagggagtgcttcccggattcgttcatttatatgccggtgaggaagctgtggctgtaggggtgtgcgctcatttacatgatggcgacagcattacaagcacccacaggggacatggacattgtatcgccaaaggctgtgatttggacggcatgatggcggaaattttcggaaaagcgaccggattgtgcaaaggcaagggcggttctatgcacattgcggatcttgataaaggcatgttaggcgcaaatggaatcgtcgggggcggctttacgctcgcatgcggatcagcgctcacggctaaatataaacagactaaaaatgtaagcgtttgctttttcggggacggggcaaataaccaaggcaccttccacgaagggctgaatttagcggctgtatggaaccttcctgtcgtgtttgttgctgaaaacaacggctatggcgaagctaccccatttgagtacgcatcagcctgtgattcaatcgccgatcgggcagctgcttataacatgccgggggttacagttgacggcaaagatattttagcagtttaccaggcagccgaggaagcgatagaaagagcaagaaacggcggcggcccgtctttgattgaatgtatgacctacagaaactacggccatttcgaaggagatgcccaaacctataaaacgaaggatgaaagagttgagcaccttgaagaaaaagatgccattcaaggttttaaaaactaccttttaaaagaaacagatgctaataagctgtcagacattgaacagcgtgtcagcgaatcgattgaaaaagccgtctcgttcagcgaagacagcccatatccaaaagattcggagctgctgacagatgtgtatgtgtcatatgaaaaaggaggaatgtaagagatggcgagagtcataagcatgtcagacgcgatcaatgaagcaatgaagcttgcgatgagaaaagacgaaaatgtgcttttgatcggtgaggatgtcgccggggagcggcggtcgatcatttgcaggatgatgaagcatggggcggtgtattaggggtcacaaaggggctcgtacaggaattcgggcgcacaagagtgctggacactccgatttctgaggcgggctatatgggtgcggctatggctgcggcatcaaccggtttgagaccgattgccgagctgatgtttaacgattttatcggcacgtgctttgaccaggtgatcaaccaaggggcgaaattccgttacatgttcggcggaaaagcgcaagtgccgattaccgtccgcaccacatacggagcagggttccgggccgctgcccagcattcacaagcgctgtatggccttttcacgagcatccctggactgaagacagttgttccatccaatccgtatgatgccaaaggtcttctgcttgcagcaatagaagataatgatccggtgttcttctttgaagacaaaacgtcctacaacatgaagggcgaggtgccggaagattattatacaattcccctcggaaaagcggatatcaaacgcgagggcaatgatgttacgctctttgcagtcggcaagcaggtcaatactgcgcttgaagcggctgcacagctttcagagaggggcatcgaagccgaggtccttgatccgcgcagtctgtcccctctggatgaggatgcgattttcacatcgttagaaaaaacaaatcgtctgatcatcattgatgaagccaatccgcgatgcagcattgccacggatattgctgcgcttgtcgctgacaagggctttgatttgcttgatgcgccgattaaacggattacagcgccgcatacaccggttccgttttcaccagtgcttgaagatcaatatttgccgacaccagataaaattgtcagcgtcacgcttgaattgcttggcgagccggcaatgaattaaagggggaacacaaatggcggtaaaagtagtgatgccaaaattgggaatggccatgaaacaaggggaagtatcgatatggaataaaaaagtaggcgacccggttgaaaagggagaaagcattgccagcattcaatcggagaaaattgaaatggagatcgaagcgcctgaaaaaggaacgctgatcgatatcaaagtgaaagagggagaagaggttccgcccggcacagcgatctgctatatcggggacgccaatgagtcggtgcaggaagaggcgagcgcgcctgttgctgaagacaatatgccgcaagccgttcagcccgtcaaacaagaaaacaaacccgcagcctccaaaaaagatcgaatgaaaatatctccagtcgccaggaaaatagcagaaaaagcaggattagacctaaaacaactgaaaggaactggaccaggcggacgaatcgtgaaggatgacgtaacaaaggctcttgctgaacagaaaaaagatcaggcaaagcctgtgtcggagcagaaagcgcaggaaatcccggtgacaggcatgagaaaggtcatcgctgcccgaatgcaggaaagcctggcaaacagcgcgcagctgacgatcacgatgaaagctgatatcaccaagcttgccactcttcaaaaacagctttcaccaactgcggaagagagatacggcacaaaactgacgatcactcattttgtctcaagagccgccgttctcgctctgcaagctcaccctgtgctgaacagcttttatcaaaatgagcgcatcatcacacatccccatgtgcaccttggtatggctgtagccttggaaaatggcttagtggtgcctgtcatccgccatgctgaaaagctatcgctgatagaactggctcaatctatctcagaaaatgccaaaaaagcacgcgagggacgtgcgggaagcgaagaactgcaaggatctactttctccattacaaaccttggcgcgtttggagttgagcatttcacaccgatactaaatccgccggaaacaggcattctcggcatcggagcaagctatgacacgccggtgtatcaaggggaggagatcgtcagaagcacgatcctgccactcagcctgacatttgatcacagagcgtgtgacggcgcccctgccgctgcattcctgaaggcgatgaaaacatatttggaagaacccgcagcattaattttataggaaaagcaggtgaaaacgacatgacattagccattatcggcggcggacctgcaggctatgcggctgcggtttccgcggcacagcagggcagaaacgtgctgcttattgacaaaggcaagcttggagggacctgcctgaatgaaggctgcatcccgacaaagtctttgttagaaagcgcaaacgttcttgataaaatcaagcatgccgacagctttggaatcgaacttccggcaggtgcgatatcagtcgattggagtaaaatgcaaagccgaaaacaacaggttgtcagtcagcttgtccaaggcgttcagtacctaatgaagaaaaatcaaatacaggttgtaaagggaacagcctcctttctttctgaaagaaagctcttgatcgaaggagaaaacggaaaagaaatcagagaggcggaccaagtattgattgcctccgggtcagagccaatcgagctgccttttgccccgtttgacggcgaatggatcatcgacagcaaagacgcgctttctctttccgagattccgtcttcactagtcattgtcggcggcggtgtcatcgggtgtgagtatgcagggctgttcgccagattgggatcgaaggtgaccatcattgaaacagcggaccagctgatcccggctgaagatgaagatattgcccgtctctttcaggagaaacttgaggaagacggtgtcgaagtgcatacctcatccagattagagcgggtggatcaaacggccaaaacggcaatatggaaaagcggtcagcgaaagtttaaaacgaaggccgattatgtgctggtggcgatcggcagaaaaccccgtcttgacggattacagcttgaacaggccggagttgatttttctccaaagggcattccggtgaatgggcacatgcagacgaacgtgcctcatatttacgcgtgcggagatgctatagggggcattcagctcgcgcatgccgctttccatgagggcatcatcgctgcttctcatgcttccggaagggatgtcaaaatcaatgagaaacatgtgccgcgctgcatctatacgtccccggaaatcgcttgtatcggaatgacagaacgtcaggcaagaagcatatacggcgatgtgaaaattggcgaatttcctttttccgcaaacggcaaggcactcattaaacagcaagcggaaggaaaggtcaaaatcgtggctgaaccggaattcggcgaaatcgtaggtgtctcgatgattggcccggacgtaaccgagctcatcggccaagcggcagcgatcatgaatggtgagatgacggcagatatggcggagcattttatcgccgcgcatccgactttatcggaaacattgcatgaggcgctgttaagcacgatcgggcttgcagtacatgcataataaaggaaaaagcaggcgcatggatataaggcgcctgctttttttattgttgaaagcgctttatttttcccctacaatagatgaaaacggcgtgtaagggaggagcgatcaaggaaatgaattcggtcccaaacgatttgcaaacctggaaacgttttgtgaaagacggtgtgcttgacgaagcccgattaagaaaacggattgccgagtcatggcatcgctgcaaaaaagctgaggtcaatccatatttagaaaaaggcccgaaggttttacagcaaacggagctggatcagcagtcaaaaaaacattcattcttcttgacgaccgcaaagccttacctcgaaaaactgctgcctgccataaaagaaatggaaatgatggcgctgctaattgattcagacggtgttgttttggcattggacggccattcccgcgcgctctatgaagccaaacgcatcaactttgtcgaaggggcatgctggacggaaacggctgtcggaacaaatgcgattggcacggcactccacattagcgagccggttgcgatacaaggatcagagcattactccattgcttcccatctttggaactgttcagccgctccgattcaccatgaggatggcagccttgcgggtgtgattgacatatcgtgtccggcggcaggcgctcatcctcatatgctcggtattgccactgcgatcgcctatgcagctgaacgggaactcgcagctaaaagccgtgagaaagagctcgagctgatcagccgttttggagagagggctgcatccagtgtgccgatggtgctatgcaataacaagcagcacatcatcagtgcgagcataccgattcgaacctcaatgcctgattggcagggccggcacctgtatgagttgaaggaacggggctactcaatcgaaaaagctgtcaccataggagatggcggcacttgtttttatctttcggaacataagaaaaagaaggtgtttcgattcaatggagtgatcgggaaaagcggccgatcgcaagcgatgctgatgaaccttgaacgtgcagctgcggcagatgcaacggtctgtttgtcgggcgaaactggtacgggaaaggaagtcgcggctcgcgcgcttcatgagaacagtgagagacggcacggtccgtttattgctgtcaattgcggagcgattccgtctgatttgattgaaagcgaactattcggatatgcagagggcgcttttacgggagcgaaacgaaatggctataaaggcgcctttcaaaaagcgaatcaaggcacattatttttagatgaaatcggagaaatttcccactcgatgcaggttgcgcttttacgagtgcttcaggaacgtaagataacgccaatcggcgggacgaaagaaattccggttgatatcagagttattgccgccacacattgtgatttacgcgagcttgtcgaaaacggaaaaatcagagaggacttgttttaccgtcttcatgtctatccaattgaactccctccattacgcgatcgcaccgaggatatcccggacctctttgagtactacaaacagaagaatcattggcccggcgaacttccttctgatttttgtgatgtgctgaagcaatggaagtggccggggaatatccgtgagctgtttaatgtgtttgaacgtctttctatcagatttccggacggtaagctgagggatgaaccgctacccgctttactggaagctgctggattgccggccagctctgcagaaaaaaagccggctgctgccggcgtgcttacctttcgtgagcaaatccaaaaggatatgatgatcaaagcacttgaatctgcaaaaggaaacgtctctcaagctgccaaaatcagcgggatcccccgtagcactttctacaaacgcctgaaaaaattcaacttgtccgctgaatcataaagcatacttccttcaggaaatggaaacgttatgtattgaaggagggtgtttacgatgaatattcaaagggcgaaagaaattgtagaatctcccgatatgaaaaaagtaacatacaacggcgttcctatatacattcagcacgtgaatgaagaaaacggaacagcaagaatttatccgcttgacgaaccgcaagaggagcatgaagtgcagctgaacagcttaaaagaggattaaacaaaaatggcccgcttcataagcaggccattttgttatccgcgcggcgcaaataaaataacacagacaccgatgagacaaatgaatgcgccgatccagtcatacagatcaggtgttttccggtcaacaagccatccccacaggaccgcaagcacgatgaatactccgccataagcggcgtatacacggccgaaagatgggaaggactgaaacgtcggaagaatgccgtatacaatgaggatcagcgccccggcgattccgtagccggctggctttgcctctctcagccatagccaaaccagatatccgccgccaatttcggcaagccctgccgcgagaaataaaagaatggtaatcagcatcatgagcactcctcaatttacatttatctttcattatagaggaggagagcttttaaagcttcggatgattctcaaattccttcaaatacgcttttcgctgaacctctgtaaattggctgatccaattgttttgagcctcttcattcaaatggggaaggatatagcgttcaaccgcttcgaaaaacagcggattcgcgatgatgttccaggtcgggattcgaacgattttcccgtctgttttctcgatgataatatcctcaaaaaagatccctttcaaactgtattgatggcgccccatataaagccgcttcacctcggaaaacagcacgctgcgctttctcgagaagatttcgccactaggcccggtctttatggtgaaaatgacatttccacggcttgtgaacgcaggaaaagccataaagaatgtgatcaatccataaatcatcgccagtaatccgccgcccaaataaagcagggcatatttagattcaaacgtgagagcttcagacaccagccagacgcccacaataaaggcgccccctgtagcgaggaacagccaagcctttagaaacatcatgctttttacttcaatcatgtgctgcccctaaagcttcggatgattctcaaattccttcaaatacgcactgcgttggatgtctgtaaactgtccgatccaattgcttttcgcctcttcattcagatgtggaaggatatagcgttcaaccgcttcgaaaaacaacggattcggaatgatgttccaagtgggaatgcgaatggtcttctgatcaacagtttggatcaatatatcttcttggaaaattccttttagactaaatttatggcggctcatctcaattttcttgatatcagtaaacgtaacagacactttgtcagtgaacacttctccattttttcctgtcttgatgcggaaaatggtatttccccgcggggtgaaagccggaaagaagatgataaataaatataaacaaaacaaggtgaacagaaagccagcaggaatggctaataggtaatatttcgtttgaaacgtaatacccatataaaagagccacaaacatgctaatcccataccggcagatccgacaaaagcccatattctcaggaacattttgcttttgacttcaatgatttcttggtttttcaatgcttttctccttttgttaattcaattcttatcattttgaaatgatttgatttacaacatccttatgagcagggaggacagaaaattcattctgggtgatgcctgtgacaagccaagtatggtgggccccggcaggacaaatgccatgtcagccacttcaggagtgttatctttaccatatgccagacgcataagtgtatccattttccctttccgcaaagccagatcatttgcaaatcgggtaacgtcctcttggtggtcatgtttttcaaggaactcttttagatatgaagggttgtctgaagcgccctccaagagtttttcaaattcatttgatgtcaatgtcacaatcgattctcttttatcctctgtatctattatatgtaaaaactcatctgtcttagcaagtaacccttcacttgattccatttttgtaatgcgatggacttgttcatcaaaaaggagttcgtgagagtaggtgccgaattttgatacatggcaggacacattctgttcggcgccttgcccgttaaatttagaaagcttcactgtatagtcagcgtcgtttaatacatggataaacggacagtactcgtcctttaaccgatattgatggttccgatattccgctgcatccttagctaagagtgagcggcaagctgcttcgaacaaagcgccgagctgttcatcttctatttccggaaaataggcctgcttcaaggccatcccctgttcaaaaaacccttcgctgtaaaagcaaaataagagttcttctatgctaattgtaaactgcttcattgtttattctcctatccaaatgaaaatttccctttaaggaaatgggttgcgccgtgtatgagcgaatccgctgttttctttgctttttccattccttttttcgcgctgtctatccctttatgtatcgatttattcgccgcatctatgccgtcattcactgatttgacgactttgccggctgattccagcccttttttggctgtatcaacgacagcatggatcggttctttcagctttaaggctgctttttcggcaaaaccggctgtatatttggcgatttgttctccgacgactccgccaatgtatgaacctgctgccccaagaaggacagtacccacaggtcctgcaaagcttccaattgcaccgccgatgacagcaccagctgtggcaccgccggcaataaaaatggtgttattcacagcattcccgacggccttggcgttttcacgcttgagaacttcgggtttgtcctggtattttgcataattttcagcaattttcacgcctgctccgaatgtttcggtcgcaccggtaatcagtgtggcggtaatggcatttcctttcgcgaatctcaagcccgtttttcccacatccttcaaagtggagcgtacgccggcttcattaagaaatccttttgtgtagcttctgacgctgtttgaaaaatccaccgtgtcctgagggaagtattttgtaaactttttatgtaccaaatctgaaaatggacggtttgtctttttcagcaaatatttaggattcaaaagcactcttgctgctttttgataacgtgagctgtcaacggccctggaaatatccaagagcagttttgagtgctgggctgtatgcaagccgcttggctgtttcacaaatttcgtaagccctaatccgtaatattttccctgcgtcagcataagggcggttaagcttgtcatcgtaccgtatttgtcgtaggcattgtagagctttcgcaaaatatcatcttgttccacaaatttatcgcccgtttttctgatgaaaatctcattgtcactcagcttggtgacgagcgcttttcctgagctccacgcatcgcccactccggaaaaacagctgctgtagaggggatcgcattgcaaaatcatctgccccagctccacatgcaggtccttatattttttttccatatcagttaattcagtgactacatcatttgcaagctgttcgagcttatccggatcaattgcaatgtttcctgacacaccgttcacctcccgagtttatgtctttcctctcttgctttacgctccagttcttccattctggcaatttcagcttttcgttcttctattttgacagcggcagccttcagctcttggcttgtttcaagcagctcctgttcgaattgatcgtaggcggctttcgtttcctcgaaatcctggtcaaacgaatctcttgctttgccctgccaagcatctcccaatgcagataaccgggattcaagcagcattttggagcttctgacctcttctgcggccgcactgtacttgtttgccagctcaatgactttatatgagtccaacttttgtcccctgccttttctaaattcacgcacaattggatgttttatataaatgattataaataattcggcatgtatccgaatcgtacaaaagaaccttttcataagaattggaagggcgtatattcacttaaaattcacagttggtgagactttaagattacaaaaaaggtaaagaaaggaacctgtaagagggagtcaacttaatattaggagtttctacgtttggaagacgaatgttttcgaggtaaccgtatataaaaaagagcctaaaataggctctaaacaaattgcgtattgcttactaatcattaaaaatagattttataatcttatttattgctaaataaacaaagaatataaacaagccactcatcacatacataattaccagtaaaatcaatttttgttttaatgtcatgtcggggactgctgagatcccgagtgtcatgccaatcataggaagcaaatagagaattaaaaagatttttttcttatatgtattccaagtgtttttcattgtctatctccttgttcttttaaaagcatcttattggtaactctataacctgtatagattgttacagtagtaatcaaatacaataaaaaaagtaaaacgatccttataccgatttggatgccaggaagcataaaagtaattaatgtcatacaaatcatgaaaaacagataatatagtaaaatgaatggttttttatactttttccaaaatcgtactattaaatagtccattttattagcctttaaaagtttcttgaaaagctttttcttcttgtgtttgatatccctcaaaaagaacttcttctatcatatcgtgattgaagaacaaattataattttcattgatattaccttctggataaggaactgaaacataatcgtactttttttgtgaagaagtttgaagctgatttctcccataaatcattacagtttttcgtacatttaaaattttcaccacactaccgataggcagcaatgtattagacattaatttctcactctttctatattaattttttttcttaagcaggtgtggatgtttttttaaccagaatttttttctgaaaatatgtaagcataaaggtataagaaaagtgaatactgaaataataaaagtaattaaatatattacttcctgaggggtttcactatcaattaaccaatatagcatgaataaactaaagataccgaaaggaactggaaaaatagaacctattaatagtgcttcattaattttttttggtaaaaacccatttttttcactcatttatatacctcctagtcatctttttctgctccaaattttatccctaaaccaataccttctgcagcataaagttcattttcaagacctgtcttcacttctaccccgacgctgccaatagatgcagttaccccaaaatagggatcatattcaattccaaaccactcttcaagtggttcatagccgaaccaattaaatggatgtatggtaagctctgcatcagcaatacttgctgatgctcctataccaaccgagtaattttcaatgccagcttttgtttcaccatgaccaattttaaccttaaataaggctggagattttttatggtcaaagtttgcattaattatattagcttctgctgcaccgccaatcatctcaccagataaaaaagagtccgtaaaactttgtaaatatggtaatgacacttctatattaccttcagccattctaaagaataattctttagattctaacttttcttccttatatgcactatttgtatctatgagacttgcgccagctttaaaatttactttttgattgcttatatctatattggcatatccattaccgaaacctttataaatagctccgttaatttctttattcttagcatactttaaattgttaatggcatcaaaagtgttatatattttttgagtaatgccttcatcatcacttttatttttattaataccatgatctgcttcgctctttgaaccgatgttcttagttcctatcgaaggatcatctgaatttgaaataccgaaaaattcgataatttcttgctcatctttagcattaattttatctaacattttacacatcggagagtctttatctagttgtgcattgttaaaaggggtataactattattacttttcagtgaatcgttgctaaattcgggttttagtactgagccacttatataattattaatttcaattcgaggaccaccgtattttgcatcaagttgttttaaataatcttccattgtggtgatatcttgatcgattgaatctagagaactagtgttttcacgatcaaaggtatatagatgttccaatgtttcgtctatattactttcagccttttttattttttctacaaaattttcgtcattcaaatctttgagacttacaatgtgtttaactttttcaatctcctcatttgctttatctgttagagatgttattgatctcttagtagctgttaacccattattcaaatcattctctaaaaaactttgcgaaataaaacctgtgtttgttggttctaatgaatataatgcactctttattttatttaatacttctttataatcactgattacacaagaataaaaaagaagaaagggagtgtggcattcactaaaaaatgttcgaatcgcagttccgccctctcctttaagggaatcatctaatgatgcaattccttgtgtacttttaattacatctgttaatttctcagcttgtttatctaattgttttatggtcttgtctatagagatgagaaatgaatgtacatcaagagttttcaaacaacgttccttccttctttacattatttattagttattgatttggaaagcacttcatctgtttcttgcatagacctaactaattgttctgtttgtgagatttgtttgtttaaggaagaagcatatttctcagccagtttatttaatttgttattcagcacattcagtttctttgtgacatcaaggttattgtggtctgttaaattagtaggaatagatactttaataacttcagttgcattttttaattttgtaattgctttttcaacttcaggtaaatcaaattttatttcattgcccatacaaactcttccttatcagtgtgaatttttatttttttgtttttctatttctttttcaatagaagtgatctgatttttcaacccatctatatcatcaattaatgtattaattttgtcttcaattttagttataacctcatctaattgtttaccttttaaatcttgatattctgagtgtatctcgtctcgaataagttcgaatttatttgctaaacttccctgccatgtatccgaggacagagatggctcagttattttattttttgactccaaaaattcttgctggatatttgtcaagttagttttgcaagctttgagatcttctaaattctccttttttaaacttagttgtgtttttacaaaggataatcccaacatttcaccaaacaactgtaaacacctcattgtcacataatatgtaattcttttgaaccgttattaaaaacaaaagggagactttcctaatgttacatgatggtatgtaatggataaataggaaatatagattatataatgatttctttgttatgttggttttaaattaatggaggtgttaagtatgaataggcctattagatcagttgtttttacctattgtaaggattccctgcaaatgagaaatttcccgctctatgggaaaaaacactaaagttgatcaaatgacctaagtgcgccaaacgtgttacgggacgggctatctcatggtataaatggaattgtaaacgttatcaaggaggtcgtcatatgaagaaaaaatcattctcaatcgtaatagcgggcggagggagcactttcactccagggatcgtactcatgctcttggaccatttggaggagtttccgatcagaaagctgaagctgtatgataatgataaggaaagacaggatcgcattgcaggcgcctgcgacgtttttatcagagaaaaagcgccggatattgaatttgaagcgacgactgacccggaagaagcttttacagatgtcgattttgttatggcgcacatcagagtagggaaatacgcgatgcgtgcgcttgatgagcaaattccgttaaagtacggagttgtcggccaggagacatgcgggccgggcgggatcgcatacggtatgcgttcgatcggcggtgtgcttgagatattagattacatggaaaaatactcgcctgatgcttggatgctcaattattccaatccggcggcgattgtggctgaagctacgagacgccttagaccgaattctaaaattctcaatatctgtgatatgccggttgggatcgaagaccggatggcgcaaattcttggcttagcttcaagaaaagaaatgaaggtccgctattacggattaaatcacttcggctggtggacatcaattcaggatcaagagggcaacgatttaatgccgaagctgaaggagcatgtatctcaatacggctatattccgaaaacagaggctgaagcggtggaggcgagctggaatgacacattcgccaaagcgcgtgacgtgcaggccgcagatcctgacacactgccgaatacgtatttgcaatattatttgttcccggatgatatggtgaaaaaatcaaatccgaatcatacgcgggcaaatgaagtgatggaaggtcgcgaagcttttattttcagccaatgtgacatgattacacgtgagcagtccacggaaaacagcgaaatcaaaatcgatgaccacgcatcatatatcgttgatcttgcccgggcgattgcctacaacacaggtgaaagaatgctgttgatcgttgaaaataacggcgcaattgcgaactttgacccgactgcgatggtcgaggtgccatgcattgtcggctcaaatgggcctgaaccgattaccgtcggcaccattccgcaattccaaaaagggcttatggagcagcaggtatccgttgagaagctgactgttgaagcatgggcggagaaatcgttccaaaagctgtggcaggcgctaattttgtcaaaaacagtgccgaacgcgcgtgtggcaagactcattctcgaggatttaatggaggccaacaaagacttctggcctgagcttgatcaaagcccgacccgtatatcataactgaaattcccccattttcgaatctgtaattgtatataatagaaagaaaatgggggatctgatatgcagctcgaagaactgatcaatcagcactacagcaaattgaatgacaacgattttcatattttaaaatatatattgaatcataagcacacatgctatcaccttggaatcgacgcgctggccaaagcttgcagtgtatcgcgttcctcaattttacggcttgcccaaaagctcggtttcagtggctacagtgaatttcgcgtctttttaaagtgggaagatcagccggaagaaggcgagagtatgagttttgaaaagctgcttgatgatattgaagcaaatttgaagttcttaaggacaaaggacatgacggacatgtgccagctgattgatgaagctgaccgcattttcgtctacggttctggaaatgcgcaaaagatatgcgcccgcgacctgcaaagaatgtttattccgcgtcatcgctatcttattttgattgaagacacgaatgaatttaatctgatgcgcggggattttaaagtgaacgatctgtttatcatcatttctctttccggagaaacaccggagctgattcctcaggcaagaatgctttctgcaaagggtattccctttatttccattacgaatttaaaaaacaatgtcctcgcccagctgactccgcataatctttatgcgacaagcaaacctgtgacattaagcgataaaacggaaattgtcgcttttgcaccgttttttctcgttggcgaagcattgttccgcgcatatgttgattacaaagaggcagaaaaaaatgacaatgagtagcagggggttctggtatgatgcaaaaaattcagcgctttggaagcgcgatgtttgtgcctgttttattattcgcgttcgccggcattatcgtcggtatcagcacgctctttaaaaataaaaccctcatgggaccgctcgccgatcctgacggtttttggtatcagtgctggtatatcattgagcagggcggctggactgtctttaaccaaatgccgctcttattcgccattggcatcccggttgctttggcgaagaaagctcaggcacgcgcttgtttggaagcgcttactgtctacctgacattcaactattttgtcagcgcgatattgacggtatggggaggagcatttggcgtcgacatgaatcaagaggtcggcggaacgagcgggttaacgatgattgcgggcataaaaacgctcgataccaacattatcggagcgatctttatttcttcaattgtcgtctttttgcataatcgctattttgataaaaaactgcccgattttctcggcatctttcaaggctcaacatatatcgtgatgatttccttctttattatgatcccaattgccttggctgtgtcttatatttggccgatggttcaatcgggaatcggctcgcttcaaagcttcctggttgcttctggggcggtgggcgtttggatatacacgtttttggaacggattttaattccgaccggccttcatcactttatttacacgccgtttatttatggcccggctgtagcggaaggcgggatcgtcacgtattgggcacagcatctcggcgaatattcgcaaagcgccaaaccgctgaaggagctctttccgcaaggcggattcgcgcttcacggcaactcgaaaatcttcggtattccgggtatcgccctggctttttatgtgacagccaaaaaggaaaagaaaaaactcgtcgcagggctgctgattcctgtcacactgacagcgattgtcgccggtattacagagccaattgagtttacgttcttattcatttcacctttcttatttgcggttcacgccgtgcttgccgccacaatgtcgacagttatgtatatggccggcgtcgtcggaaatatgggaggcggactgattgaggcggtgaccttgaactggattccgctctttggcagccacggtatgacatatgtgtatcaaattttgatcgggctctcgtttacagcaatttattttttcgtcttcagatttttaatcctcaaattcaatatcgctacaccaggacgggaaaaggatgaacagcaggaaacaaagctgtattcgaaaaaggaatacagagaaagaaaaaacaaggatgaaacggcctctgctgctgaaactgctgatgacaccgcttttctgtatattgaagcgctgggcggaaaagacaacatcactgaagtcacaaactgcgccacccgcctcagagtcagtgtcaaggatgaaacaaaggttgaacccgacagcgtattccgcgcgcttggcgcacacggcgttgtcaggaacgggaaggcgtttcaggtaattatcggattaagcgtaccgcagatgcgggagcgtgtggaaaaaatattgaatcaataaagacagccctccttttcgggagggttttcgtttgccgtcaaaaagaccgccatagtaaagtaaagaaagagacaatcgagtaaaaagggtttggaggcttttacatgcaaaaggctttgtcgtttttaaaaccatattcattgctggcgggaattgctctgattcttatgttgacggagcttgcagttgaactgatgcagcctttattgattgcaaaaatcatcgacgatgggatattgaagcaagatctgcggcatgtatggatatggggcgcggtcatgatcgggctgaccgtgttatcctttgcggcggggatgctgaattccttttatgccgcccatgtcagccaaagcttttcctatgatacgagaaaagtgctttttcaaaaaatccagtccttctcctattccacatttggacagttttcgtcctcttcttatattacaaggctgacaaacgacgtcacacaggttcaaaatatgatttttatgagtttgcggtttatgctgcgggctcccttaatgattgcaggcggcattgtgctgtcgcttgccgttaatgtgaaactcggcttttttctgcttgtgaccattccgatcctgatcttgtttttgctatgggtattaaggaaaggcggggcactgttccgctcagtgcagaaaaggctggatcaagtgaacaccatcatgcaggaaaatttaattgcaatcaagctgatcaaagcgctgcttcgcggcagccacgaagtcaaacgatttatcaaagccaacacaaggctgatggaaaaaacggtttcggcctttcagcttgtggaattcacgatgcctgtactgatgcttttgatgaatctctgcatccttttgattttgtgggcggggtcctacagtattacgagcggaagcactcaggttggcgatgttgttgcgataattaactacgcaacacgaattacgggcgcgctttcgatgtttccgtttttgattatgattttcaccagggcgaaggcttcaggggatagaatcggcgaggtgcttgaaacagaaggcgacgagcgggaggaaggcatcatatctgatcgtttgtcaggacggattgagtttcagcatgtatcctttcgctatcctgaaatggacagagaagcgctcaggaatgtctcattttccgcaaagccgagagaaatgatcgcgattctcggtgcgacgggctcgggcaagtccacgctttttcagctcattccgcggctttatcagccggattcaggccgcatttacatagataaaaagccggttcaagattttccggctgaagggctgcgcaggcaaattggatatgtacctcaggaagtcctcttgttttccggcacaatcaaagaaaacatcgcttggggcaaagaaaatgcttcactagatgaaataatagatgcggccaaacatgcgcaaattcatgaaacgattttgaagctcccaaatggatatgacacagttttggggcaaagaggcgtcaacctgtccggcggccaaaaacagcgaatttccattgcgcgggcactgattcgaaaaccggctatccttctattagatgacagcacaagcgcgcttgatctgcaaacggaggcgaagctgcttgaagcaatcagcacataccattgcacaactttgatcattacacaaaaaataaccacggcgatgaaagctgatcagattttgctgcttgaggacggcgaactgattgaaaaaggcactcatagtgagctgctttctgcatctcagttatacaagcgcatttacgagtcacaattcggaagggaggggagcgagtcatgctaaaagacatccgcaagcctttccaatatcccaaactgccaattgacaaaaaagaaggcgcgaaaaagcgggcgaaagcaaaggatacaaagggcacactgagacgaatctggtcttacttggctgaacgaaaaggactgctcgtacttgtcatgctgatggttgtcatcagcgcgatattcgggctccttggcccctttgtgatcggaaaggccattgaccattttatcgtcgggaaaacggtcagcggcttgattcccgttttgcttcttctgctcgctatctatatcattcagtccctgtcgctttggtttcaaaactattggatgattacgatctcgcagggcacggttttcagaatgagaagcgaattgttcacccatctgcatgagctgccgattccattttttgataaacagcggcacggcgagctgatgagccgggtgacgaatgacatcgaaaatgtcagttctactttaaacacgtcagtcattcaaattttgtcaagcgtgatcacctttgtcgggaccattgcggtgatgctgtacatgagcccgctccttacattgattacgctgaccattattccggtgatggcagcgagcctgaaatggatcaccaaccgaacgggaaagctgtttaaagaacagcagaaaaaccttggtgatctgaatgggtatattgaggaatctgtttcaggcgcaaaggtcatcaaagcatattcacgtgagaagcagattactgctgaatttctcgaaaaaaacgctgcactcaagacgtcgggcttttgggcgcagacgatttccgggtttatcccgaaggtcatgaactctttgaataacttaagctttacaatgatagcggcaatcggcggtttgtttgcgctgaaaggctggatctcgatcggctccatcgtcgtctttgccgagtattcaagacaatttacacgccctttaaacgatctggccaaccagtttaatacgatgctgtccgcaatcgccggcgctgaacgggtgtttgacgtgcttgatgaaaaagaagagcgcgaggatgaaaagaacgccgtgcatcagcccatccaaacaggcagcattgaattccgggatgtgtccttcggttacgataaagggcagcagacactgaagcatttacagtttaccgtgcctgccgggcagtccatcgcgtttgtcgggccgacgggggcgggaaagacgaccgtcaccaacctactcgcccgtttttacgagcctgacaaaggaaaaattttaatcgatggtactgatattaaaacccttactagagcaagcctgagaaaaaacatggggtttgttcttcaggattctttcttatttcagggaacgatcagagaaaacattcgctacggcaggcttgatgcttctgatcaggaagtcgaagccgctgcaaaaacagcgaatgcccatagttttattgaaaggctgccaaaagggtatgacaccgtgctgacgcaaaacggttcgggcatcagtcaaggacagaagcagttgatttctatagcgagggcggtgcttgccgatccggttcttctcattttggatgaagcgacaagcaacattgataccgttacagaagtcaacattcaagaagcgctcgcccgtttaatggaaggaagaacaagcgtcatcattgcccacaggctgaacaccattcaaagagcggaccagattgtggtgctaaaagacggtgaaatgattgaaaaaggcagccatgacgagctgattcggcaaaaaggattttacggtgacttatatgaaagccaatttgagaaatagacctttgtcctgcacagaggtcttttttgttacagatttatagtacttttatttcattttcgtaaaatgtaacaaaattacttgacgtaaacaagttatgtatatatactagcttacattaagtaagtgataacatttatcaaggaggataaaatgaataaatcatttgaaattggcacattacttttaagagttattacaggtattatcttttttgttcacggtttatcaaagtttcagggaatggagggcaccatccaatttttcggcagcataggccttccaagctttatggcgtatgtcatcgcagcgattgaactcattggcggagtgctggtcttcttcggattggctacacgtattgtcggtgtactgttcgctcttacactgatcggcgccatcatcactgttaagctgaaagcgccattcatgggcaatgcagaatttgattaccttctgcttttgacatccattcacctggcgcttactggaagtcgattcctggcgctggacccatttgtgtttaaaggaaaaaagaacggaaacgtttcagcataagaaaagaggcatgcagcatgaccagcattcatgaggatacacacattggctatgccaaactcacaattcgcagtctggagcgttcgcttcagttctactgtaacgtcatcggttttcaagtcttaaaaaagacggatcgccaagctgaattaacggctgacgggaaacgcgtactgcttattcttgaagaaaatccgagcgctgtcgtcttgcctgaacggtctgtgacaggcctttatcactttgcgattcttcttccggacaggaaggaacttgggatcgcgctcgcccgcttgattgaacacggcattgctatcggacatggggaccatgctgtcagcgaagcgctctacctgtctgatcctgacggaaacggcattgaaatgtatgctgaccgcccccgcagcacgtggcagcgtgatctggaaggaaactatgtcatgacgacaaccgctgttgacattgagggccttctggaagaggcaggagatgagcggaaaacatcgcttccgaacgatacaatcatcggacacattcatctgcatgtcagtgatttgaaagaagcaaaggcgttttatacagatgtactgggctttgacattgtcggaaactatgcgggcatgtccgccctcttcgtttcagccgggggtaccaccatcatatcggcttaaacatttgggcgggaagaaatgcgccgcctaaaccgacaaatgccagcggactagactattacactgttgtcctgcctcaccaagaggagctggttttagtggcgaaccgagtcaaacatgccgggtattcgattgaagagacggaaaacagttttcgtgtgaaagaccctgtttccggcgcctatattacatttgtgatttaactgcaatccccttgccgaaaaaacggcagagggattttttattttccagaaactcctgtcaaaaatgccctcaggcaggtatgataagaagggaattgggcatcgggagtgatgagcgtgaaggctcttttttttactaggattttcaccttaatggtaagctgttcggtttatttttttcttgtagaggatgacagctggtttgagtatttgttcatcgctggcggtgcgagtgtattcttagcaaatcatctcttattaagggtacagaaatatgcaattattttttgtctaattgatattgcagttggcttttcgttcggtttcatgtttccgggtacaggtttatatattacattgctcagcccggttgctgttaccttttttctgaagggatttgaccgaaaaacggtatggtctgtcctgtgtttttgttttatgatgtggctgattgttctattacgcacatatcatatgcttggtgatgaatatgtgatggatcattgcatcagcatgacattcgttgtcttctgcggtgtcgtgggcaaattaatccgcaagctgttggaggctcaggatacggcaaaacagcagtttcaggaactgacggagtcccatctggcgctgtctgccgcacatcaggagctccatttatatgcgaagcaagttgaagagctgactgccatttacgagcggaacagaatggcgcgggaaatccatgatacagtggggcataaaatgacggcccttcttgtccagctgcagcttttgcgtgaatggcaaaaaagagacagccaaaaagcggatgagacagtaggtgtctgtgaaacacttgcccgtgaagcgcttgatgatgtccgcttatcagtacgcactctgcaaactgaaaacgatccttcgctaatcgaatcgctgaaacagctgacagaggacttttgcaaaaatgcaggagtcacaacagaatttgcggtcagcggtgatccagcaatcatcccgctgtctctccatccgaccctgatcagaacggtgcaggaagcactgaccaatgccaaacggcacggcggcgccacagcctgttcgatacagcttgcctgcacaacggacagcatcagccttgtcattaaggatgacggcaaaggcaatcccgaggcagcacttggttttggtctcttgaatatgaaaaagcgggcagcggaacatggcggaatgatccgctttgaaagcgaacaggatcaaggatttactgtgaatgcagaattttcacttgccaataaaaaatggagcttcaggcccgtgcagcaaaaggagagtttatcatgattaagatcatcattaccgacgatcaggatatcgtcagagaagggctggcatccctgctccagctccgagaagagctcgatgtgatcgcaacggcgcgaaacggacaggaagcattcgaaaaggcgaaagagctggagccggatatcgtattaatggacatccgcatgccggtttccaacggggtggagggaacaaaattaatcacaagctcgctgcccggcgtaaaggttttgatgctgacaacctttaaggattcagcgctgattgctgaagcgcttgaagaaggagcaagcgggtacctgctgaaggatatgtcggcagatacgattgtaaaagcggtgatgactgttcattctggcggaatggtgcttccgccggaattgactgcccaaatgctgaatgaatggaagcgtgaaaaacaactgaaaggaataaatgagatagaaaaacctaaggagctgctcggcctgaccgagcgcgaaatcgaagttctggctgagctgggatacgggctgaataacaaagaaattgccgaaaagctttacattacagaaggcacagtcaaaaaccacgtttcaaatattatcagtaagctggctgtcagggacagaacccaagccgccatttactcggtcagatatggtgtatctgtcttttgacatatgacgttttgcatatacgcttctctgaaaaggccttttacaggcctttttttcatgccctatgttctatctgccgctacatgccgcacgcctttctttcttctacaatggcaatggatcaaaaaaggagtgagacgacgtgctgcaagcagaaaatatcaaaaaggcatatgggaaaaaaacaatcgtgaaaggcatttctttttccctccaaaagggggagtcgttcggtctgctcgggccaaacggtgcggggaagtccacaaccatctcgatgatttccggccttgtgccgcatgacagcgggaacatcacggtgggcggctatgtcatcggaaaagaaacggccaaagcgaaacaaaaaatcggcattgttccgcaggaaattgcattatatccgacgctgacggctcatgagaatcttatgttttgggggaaaatgtacggacttacgcatggtgaggccaaaaaaagatcggcagaggtccttgaatatgtcggtctgactgagcgggctaaagataagattgaaacattctccgggggaatgaaacgaagaatcaacatcggtgcggctttaatgcataagcccgagctgctgattatggatgagccgactgtcggtattgaccctcaatcgagaaatcacattttagaaacggttaaacagctcaacgaaacgggcatgacggtgatctatacgagtcattacatggaagaagttgagtttttatgcgacaggatcgggataattgatcagggggaaatgattgcgattggcacaaaaactgatttgtgcagccgccttgggggcgataccatcattcagctcacggtcagcgggatcaatgaagcgtttcttgtggcgatccgatctctggcccatgtgaatgatgtaacagtacatgaattagagctcaaaattgacatttctgtggctcatcatgagaaagtcgtcaccagcctgcttgctgaagctgctgctcatcatataaacctgctgtcccttcaggtgcaggaaccgaatctggagcgcctgtttctgaatctgaccggccgcacgttgcgggattgaggagggacggcaatgaaaaaaagcatatggatcgcatggaaagatgtcaaaatcagaatcacggacagaaaagggtttatgatgcttatcctaatgccgctgatcctaacgtgtattttaggggcagcgctcggatcagttgttgacggaggcagccggattgatgacatcaaagtcggctacattcaatcagaccagtcagatgcagcaaacatgtttacaaaagatgttctcaaaaaaatgaagtcgataaaggccacaaaagccggcagcaaagacaagatgaaaaaactgattgatgaaaagaaaatcgatgtaggcatcgttatcccgaaccattgggaagccggcaaaacctcagctgttgttaatgccgctcctgatcaaacattgaaaagttccatcattgaaacagctgcaagctcatttatagagcaatataaagcggtaaaggaagccgcgtcagcctcaatggactacatcagcaaaacggaagctgtacagcaaggaaaacttgaccctgcacagtttgcagaaaagctggcaaagacgctagaaaaagaaacaggtgacaagctgactattgcggaaaaatctgtgggcagcaaagccgttaccagttttcaatactattcggcggcaatgctttgcatgtttatgctgtttcatatcacagtcggggcgaaatcatttttacaggaaaaggatacggagacgcttgccagaatgctgatgacgcctgcgcaaaaatccgtcattctcttcggaaaatggcttgggacgtatctgtttgccatcatacaatttttcatatttctgatcgtcacaatcaatgtatttggtgtggactggggcggtaatctgctgttcgtgagtgtactcgggctttcttacgccgcagctgtatctggtatttcaatgctgcttgcgtcgtgcatcagcgatatgaaaactgcagatgcgataggcggcttcggcattcaattgcttgcggttctcggcgggtccatgctgccgctgtaccaatttccggacgtcttgcagtctgtatccaaagcggtgccaaatcgctgggcgcttgacggctttctttctttaatggaagggggaggctgggctgaccttcaaaagcctgtgcttctttttgcggcgatcggcttttgttcacttgtaattggtatcagacggcttcatacaagataaggaggtacaaaaggtgaaaaaaattctagccatttgcggcattgagctttctctcatttttaagaagccacagaactatttgatcatgtttgctgccccgcttttgcttacctttgtatttgggagtatgctcagcggcaatgatgataaggtgcggcttgcaatcgttgatcaggacgatacgattctctcacagcattatattcggcagctgaaggcacacgatgatatgtatgtattcgaaaacatgtctgaaagcaaagcgtcagaaaagctgaaacaaaagaaaattgccgggatcatcgtcatttcccgctcgttccagacacagctggaaaaagacaaacatcctgaactgattttccgtcacggccctgagctgtcggaagcgccgatggtcaaacaatatgcagaaagcacattggcaacgctcaatattcaggtgaccgcggcaaaaacggcatcgcagacagctggagagaactggaaggctgcgtataaaaccgttttcgccaaaaaacatgaagatacagttccggctgtaacacgacagacgctcagtgataaaaaagagggtgcggaagcaagtgacacagcctccagagcagcagggttttccatcctgtttgtcatgctgaccatgatgggagcggctggaaccattttagaagcaagaaaaaacggcgtatggtccagattgcttacagcctctgtcagccgagccgaaatcggtgctgggtatgtgctgtccttctttgtcattggctggattcaatttggcatattgcttctcgcaacccattggctgtttggcatcaactgggggaatccggctgcggttatggtgttggtgtcgctttttctgctgaccgttgtcggcattggattgatgattgcggccaatgtcagaacgccagaacagcagcttgcgttcggtaacttgttcgtcatcgcaacatgtatggtgagcgggatgtattggccgatcgacattgaaccgaaatttatgcaatccatcgctgaatttcttccgcaaaagtgggcgatgagcgggctgacagagattatcgctaacggtgcccgcgtcacagatattctcggaatctgcggcatcttgcttgcttttgcagcaatcactttcgcagcggggctgaaagcgctccgagcctaaaaaacatctgccgtttaggcagatgtttttttgcatgtaggtacattcgtatgggtgcagcctgaactgcggttaatccttatctatcatagctaaaattgattccagccaagaaacgtaatttttctcccgctccagcgctttcgtcagcacaagatagtggccgaagtccggtgaagaaaatgacatcggctctgctgaagccataagcttttcatagcttccctgtaagtcagaaagcttggcctggcgtttttgcagctggtctttgaacaaatcagaagcctcctggcgcgatagacaagaaatgaaataagccttcagcataaattcatccttcaccgtctcgggtatcggctggtggcggatcagccagtcatgaagttcctgctttccgctgtctgtcagggtgtacatctttttctccagctttgtgccctgaatcgttgtccggaacgtgataaatccttcatccgtcagctttttgagctcagggtaaatctggctgtgcttggcgctccaaaactggccgagctcctctttaaaataactcgtaatatcgtatccactcaattcgccttttcgcaaaagccctaatatggcgtattttaatactctcatgctatcctccgtgtctggctgtttcgcaaaacagatgagccggtgctcaactgtgattctaactgcctattccccttattatagaaaagggaggaagggaacacaaccgggctctttggaaatgaagataaaaggtttgtcagtaggtatccgatttatctccgtcaatataaaagagatttaaatttaattttcagaaaaaatattaaccatattgattttttatgtataataggaaattggtgttatcaacattttaagggggaataaacgtgaaaaaagtacttatggcattcattatttgtttatcgctgattctatctgttttagccgctccgccgtctggcgcaaaagctgaatcagtacataatcctgtcgttcttgttcatggaataagtggtgcatcatacaactttttcgctattaaaaactacttaatttctcaaggctggcaaagcaacaaactgtacgcaattgatttttatgataaaacaggaaataacctaaataacggcccgcagcttgcttcatatgttgaccgtgttttaaaagagacgggggcaaaaaaagtagatattgtggctcatagtatgggaggcgccaatacgctgtactatattaaatatttaggcggaggcaataagattcaaaatgtcgtaacgcttggaggggctaatggtttagtgtcatcaaccgcgctgccgggtacagatcctaatcaaaagatcctctatacatctatttacagtctcaatgatcaaattgtcatcaatagcttgtctcggttacaaggagcgcgaaacatccagctttatggcatcggtcatattggcttgctctctaatagccaagtgaacggctatatcaaagaagggctgaatggcggaggcctcaatacaaattaatatcttcataaaaaacctgcagtctccgttacggcaggttttttgcatttttctagcaatctcgtctgagaaagatacaccaataagccagaggggtttatgaccttagtctatcatgcatacgtcaatttatgacatcaggcactttttcaaatagagcggacatgttaaggtacaaccatcgatttctatcaatttgaaataaaaggagcgctgttatgcaaattaaagaaatttttatgatccgctgcatttcgtgcttaagtgtcgtcttgctccatatcatttcaatggtcctgatgcttcaggcagaagctcttgcagatatttctcacactgttgattctttccgcacactcctgatgttcagcacgcccgcttttattttcatctctgaatttttactggcccgttcttatcctgatggggtgcctgacggttttttaaagaagcggggaaaagtgatttttgttccttttttatttatcgcggccatcgatgcgctgctgatgaccagtgcgatgggggagaggtaacctttctcgcgtttgtgcaaaaatatctggagaacgtattcttaggaaactttatcggatacttcattctcgtcatctttcaattttacatgctgcatatgatgtttcatgagtatttgaaaaaagcatcgccgaaatgggtgctgtctatctcatttgtggtgacagccgcttatttaggctatttctccgcagccagcccggctcctgcttctgaagagggaggggcatttccgttcttctgggttccgttcgcaggctggcttttctacttttgtctagcctactattgcggaaaagaatacaagcgttttttagcgctgctgaaccaataccgctgggtggtgtacggcgctgcaattgcttctggggcgctggttgtcactgtttcttatgtcggtgaaatcggcatgatcagctcgaagcggcctgatatcatgctgtattcaacaagcatgattttcctgtgttttcacttgttttccaaaatgaagcatgtgccgaaaatcatgatgtttatcagcaactattccttttcgatttatctgcttcatgcctattttatgattataggctacgtgttgcttttgaatatgcccgaaattcctgccgtaccggctgttctcctgctgtttgccgtgtgtacagccggcccgattctgacctcgtgggcactgaataaattcaaatacgggtatttatttgtggggaaaatttatcagccaaaacagaagaaggtaacagtcgaagtgcgtgatcacgcagggtgaaaagcaagcggcaggagggctcctgccgcgtttctttacttctcatccgcttgcagaactgtttttaaatatagttttgcagactcagcaagtccagatacatcagctttttcttcatcgaaatacagggcgttttgaatgatgccgtcattcatattgaggaaaaacttggcgatagtcgcaagaggctgaagcggctgaaactctccctgatcgatccctttttgcaatagctttgaaaatctttccacaaaaagatcataccttttctccaaatactgcctacgttcctcattccgccaagctgtcactaaatattcaaattgcaccggcgccagcgtatctgctacatcacgcaggccctcagtcagttcatccaaatagattgaaatggcggaccaaacactttggtgttcagctgatttatcaagctttcggagtccttcatccagccctgtttcaataatgcggcgaaacatctcctcagtgcttgaaaaataaagatagacaccgccccggctgaaacctgactcttctacaacgtccttcatcgtcgttaattcgaatcctttacgtttaaaaaccgttttggcagcctctaaaatctttgcctgtcgtttatccttgtgctcctttgttacttttggtgacaagatatcgcctgctttctgaaactttcttacctacaagtgtaatcaacccaatcaagatcagcaagcagccacagacaagaaaagcaagtgaaacaccgatccattccgccagcatgcctccgcccgccatgccgaggatggaggcgagggttgtcgcgctctgaatggcgccaaacaccctgccgctgtaatcaaccggcactgttgtttgcacgagaatttgaaatggaatatggaccagaccaaaagccgctcccatgatgaaaaaagcgaaaataaaaagagcaatgccggcaattcccattccgctcagaaatggcacgcctccagttgctagtccaagcagaaaggtcccagctgagaaataaagaaaataagaggtgattcgccgtctgccggcaattgccgccgtaaggagcatgccggctccgctgacggccatgcaccagcctgcaagctcaggcggagcgcctgaaaaagaacggataagaatgatagcctgggaatcaccaatctgcaaaacaaagagaacgacgcaagctgtgagtaagcctgttaatagaagcggcatccgtttcaaaaactgaaggccttccttgatagaagtaagtgctggtgttttttcttgaggtgtattggctttttgtaaaaaagcatctctgggaaggaaaaacaaaatgacagcggaaagaaagaaggcgccggcgtttatataaaaaacagagtgtatcgagaaagcagcgatcagtgtgccgccaagggcagggccgaagatttttgagctgttatcaatgatgctgctgacggaaacggcctgctgaatgtgtgcttccggagccaattccttaagctttccgtttttagcaggtaaaaaaagtgaagaaaaacagctctgaacggatagcaatacgtaaagctgccaaagctcactgacataaacgcagctgataacagtgagggcacggccgatttcagatagaaacataatcgtttttctgtcaaaacggtcggcgagtaggcccgatacaggtccaagtacaatgacaggcaaagcaaatgacatcattaaaagcgacatatctaatggtgaagcatccagctgaaaagcggctaaggttagcacggccaaaatgtgaagccagtctccaagtgaagaaatggtttgcgaggctaacagtgtcatcagccctttttgagtgcaaaacaacggtttttccatgattcatcctcctaaataataaaaatgacactagtgtcgtttttattgtatgggaaaaagacgcaatacacaatctttttcttgtaaaataaaggagaagcttgaatagaagggagaacatgcatgacatcagtcaatctaagctacccaataggagaatacaagccgagggaatccatatcgaaggagcaaaaagataaatggattcaagtgcttgaagaagtgccggcaaaattgaagcaagctgtagagggcatgacggacagccagcttgacacaccgtaccgggacggtggatggaccgttcggcaagttattcatcatctggctgacagtcatatgaacagctatattcgttttaaattgagcttgacggaagagacaccggctatccgtccgtatgatgaaaaagcatggtcggagctaaaagactcgaaaacggcagatccgagcggctcactcgcgcttttgcaggagcttcacggaagatggacggctctgctccgcactctgacggatcagcaatttaagcgcggattttatcaccctgatacaaaggagatcattaccctggagaacgcgctcggcctgtatgtctggcactcacatcaccatatcgctcatattacggagctttccagacggatggggtggtcttaacgcttttgccggcggaaagccggaatactgatagcagcaatcaccagaagtgagatcacagcagccgctgcatataaatgatcatagccgctggcgacactcgcatgaatggcgtcgcttatcgcggttttgacttcaggaacgggaatgcgttcgatttgttcttgtaaagaagaaacatcagaactgtcgatctccggaatcatctgcatcgccttttctgaatatccgctgtccgataagcggctgctgatctcatcacctatttggtcaaacccggctgtgataaaacctgcataaagagtaggcgccaaggtcagtccaatttgccttactaatgaaagcgtgccaagcgctgtacccttatttgtttttgccgcttctgatacaaggacgttcagcggagcgcctaacagaaagccaaaaccgatcccagcgactacactagcgattataaactcccatttttccgtcacccagagcggaaataaagcaaaccccgcacatgagatgattcccgaaagaataacggtttttacaggaccttttttgtcggtaagcgctccgccaagccaagcgccgattccggaagccaacgcaagcggtgtcatccaatagcctgcttttgcggcagggacacccaaatactgctcgacatatgacgggataaaaatgactgccgccaagagcccccggataacaaaccgatgataagcgtgcgctgaaacatatggtttcgcagcagagaatacgccaaaatggatcgcctcctcgcatttcaactatcttttcatacgagataagcgctgcaaaacagagtatgccaaaaataatacatccataaaccttcggattccccaagctgtgtaagagatttgccccgtcaaggttcgtcatgccgtacatcacggctaaaatcgacagggacagaaggaagattccggccgcatcgaggcgcttagcttcaggtgcttttgtttccgcgataaagtatgagccgaaaacaaccaatagcacggcaatcggcaaattaatcaaaaacagccaatgccaagacccggtccaatcaagcagaaagcttccgatatttggcccgagcacagcggccatcccgttcattgcgccaagcagcccaagcgccttcccctgtttttcctttggaagggtcgcgagaatgtgagagctgccgatgatgaaaatcccgccgcctccaagcgcctgaatcagccgcgatatcagaaagagcgggaagctttggctcaaagcaacaagcaaagaaccaagtccgaacaggcaaacctcaatgagaaagagtttttttctgccgtagcggtcggaaagctttccgacgattggcacactgacgctaagaccaagcgtataaagggtaatgccccatgatccccaggaaggagaaacggaaaacgactcgtttatcgttgttaaggcagctgaaataattccgttatctagcgcagccataaatacaccaatcgtaaacaggctgatcgcccacttttggcctttctgctctgttaatgcttcagacatattcatcaaccccttttttattcattcaaagtatattattcattttaaatgaactaaatgtcaaataaaaaaagcctgctcccgcagtttgcggatgacagacttacagatttattcttttttcgctttctctaatgctcttgaaaggatagacagcccttcggaaaccgcctgcttttcttcaggggacagcagctctaatgaacgcttcaatttcaggtggcctttttcatacaaaccccggaaaatctttttcgcattctctgtcaactgaacaactacagagcggcggtcctcttcagaatgtgagcgtttgacaaatcctgatttttcaagccggtcaagcagcccagttgtattggacagggaagcccccattttttcagcaatgtcgctcactttcaatgttccatggttgtttaatagcatcagcaccttcatttgcggcatgctcatatccagcttcatccactcggacacatcaccgagcccggcggacgttaagactttcatatagagcacccatatttcccgttcctccgatgaaagaatgttttcgtttaatactgttgtatcgtgtaaattatattccatttcatcacttcctcatcattcactcctcttaccatattactcgattttcactccagaaagaaagtgagcagaaaccgcatgcgggactttgtccgaaaaataacggtagtgtataatgagttggagattattgggggagaggatcgaactagaatatgattggagagaccattgctgattaaaaagaatgctttatcaatattaaaaatcgtttttcctattgctgttttgctatttgttatttatcaatcgaaaaaagaactgacaaatctgtctttcaaacgtacgctcatggtcatcaacggactggaacgaacggacttattcatgcttgtgttgatcggcttgctggctgttgcggccatgtcgctgtatgattacgtcctgaaatactcactgcgcctatcgatcacaaacggaaaagtattcagggtttcctggatcgccaattcatttaataatgtgctgggcttcggcggtttagccggcgtcgggttaagaatgatgttctataaggagcatacgaaagaccataaggcactcgtgaaaggaatcgcctggctcacatcatctatgctgctcggattatctgttttcagcattttcgtcgctgcgagagtgctgccagtggatgaagtgattcatgaaaagccttggctatgggcggtcgttatcggttttgcgctgatattgccgctgtctttggcggtgtccaaaataaaagaccgcaaagctggggacgaagagaatgcggataaagtgaaaaatccgattttcgcatatattggagcttcagttgttgaatggctcatggccgggatcgtcatctattttgctttgttcgctatgggcattcatgcagatatcaggtatgtgttcggggtgttcgtcattgcggcgatcggaggaatgatcagcctcgtgccgggcggcttcggctcgtttgaccttttatttttgctggggatggagcagcttggctatcatcaagaggccatcgttacttctattgtgttgtacaggctcgcctactcatttatcccatttatcttgggactgttctttgccgccggcgacctgacggaaaatacaatgaagcggctcgaaacgaacccgcgcatcgcaccggcaattgagacgacaaacgttctgcttgttgttcagcgtgcggtattagtgagaattttgcaaggctcgctttcccttattgtgttcgtagcaggtctgattgtcttggcctctgtttccttgccgattgacaggctgacggttataccgcacattccgcgcccggcgcttttgctgttcaacggcctgtccttaagctcagcactcattctgctaattttgccgatcgagctttataaacggacaaaacgttcctacacgatggccattacagcgcttgtcggcggctttgtgttcagctttttaaaagggcttaacatcagcgcgatattcgtactgccgatgattatcgtattgcttgtgctattgaaaaaacaatttgtccgcgaacaggcatcctatacactgggacaattgatattcgctgtggcgctgtttactgtggcgctctttaactacaatctgatcgcgggctttatttgggaccggatgaagaaggtgctgcgtcacgaatatttcgtccacagcacctcgcatattacacatgcaaccatcatggcgatcatcattgtgccgctgttcttcttgatatttacagtggtctatcataagagaacgaaaccgatcggagagcaagctgaccctgagcgtcttgctgcgtttcttaatgaaaaaggcggcaacgcgctgagccatcttggttttcttggagataagcggttttatttttccagtgatgggaatgcactgcttctatttgggaaaatcgccagaaggctggtcgtgctcggcgatccatctggccaaagagaatcattcccgctcgtgctggaagaatttctaaacgaagcgcatcagaagggattcagtgttttgttctatcaaattgaacgagaggacatggcgctgtatcacgattttggctacaacttctttaaacttggcgaggaagcatatgtagatttaaatacattcaccttgactgggaagaaaaaagctggccttcgggcaatcaataaccgctttgagcgggaggagtatactttccatgtggatcatcccccattttctgatgcgtttttggaggagctgaagcaaatctcagacgaatggctcggctcgaaaaaggagaagggattctcgctcggattttttgatccttcctatttacagaaagcgccgatcgcctatatgaaaaatgcagaaggagagatcgttgcattcgcaaatgtcatgccgatgtaccaggagggagagatatcggttgacctaatgcgctatcgcggcgacgcaccaaatggcattatggacgcattgtttatccgtatgtttttatgggcaaaggaagagggctgcacgtcatttaatatggggatggcacccttggctaatgtcggcactgcctttacatccttctggtccgaaaggtttgccgctgtcatttttaataatgtcagatacatgtacagcttcagcggcctaagagcctttaaagaaaaatacaaaccggagtggcgagggaaatacttagcgtatcggaaaaacagatctctttctgttaccatgttcctcgttacacgtctgattggcaaaagcaaaaaagactccgtctaataagacggagtcttttttttatttcgtttttaagaagtaggtttcaatatcatcaagcaggtagtttgcggctttaattccgcctgcggttgtccatacgacgtcatcgacttcatgcgcattacctgatttcacggcctttaggtttttccatagtgaactgcttgtccactgattggcccatttttcattttcctttgcattatcggctttataagtgaaataaaacagcacatcagcatccatatcaggaatagattctttactgtcagttgagaacgtaaattggtccttttgtttcttgaacagttctacttgtttttcagggcgtttgaagccaagctggtctaaaataatccctgagaatgaatcggtataatagattcttgattcaccggataaaaagcgtacgactgaaacggttttgtttgtctggtcgcccagcttgttttttaaatcagaaacacgtttatcaaaatcggcaatgacttccttgcctttgtccgccttattcaccgcgttggcgtatagagtcaggttatccttccagttcccggccaaagattcagcaaaaacagtcggcgcaatcgcatttaactgatcataaattttttcctggcgcactttgtttccaataatcaaatcaggctttaattctgcgatggcttccacattcggttccgtttcaagaccgacgtttttaacacctttcatgtcatctttcagatagtcataccacgggtcgcccttccatgactttacggctccgaccggcttaatgccaagcgctaagagcgcctctgttccttcattagttaaaacaacaatccgttttggattggcgggaatgttgtctgatgtccccattgcatgtttgaccgttcttgttttgctgcttgacccctcgctgttgcttgaactttctgaactattacaggcagaaagtaccataacggccattaaaaatacgaatagcatgctgatatgctttttcatctttttcctcccaatattgaaattcattatcatttagatcataataagcagtgttaagagtgtcaatccctaattgaggattattctcaaaaacaaacattacatagtaaataactaggagaattagatcatgatctgcaaaaaggcatcttcaaaatggattgtgttagtatgtctgattttcattttactggcggctgtctgcgcaagcgtcgtgtacggctatacaggtacgtcatggagacaggtctatcaggcatttacttccttcaacggaacaaatgagcatgtcatcatcaaggatgtcaggcttccgcgcgctttggttgcgacagtcgtcggcgcctcgcttgcagccgcaggcgctctcatgcaggcgctcacaaaaaatccgcttgcgtcaccggggattttcgggattaacgccggtgcaggtttttttattgttgccggatcgttttttctgcatattcagtcacctcaggcattagtatggagctcgtttctgggggcagcatttaccgccgcgatcgtctatgcagcaggctcgcttgggagggaagggctgacgccaatcaaactgacgctggcgggagctgccatggcagccatgttttcttctctgacacagggcttgctgtctgtcaacgaactcgagcttgcccaggtgcttttttggctgactggctctgtgcagggccggagtctggatctgttgatgacgatgtttccatatgcagcggcagcgctggtaatctgcttctttctcggccaaaaaattaatctcctcgttatgggagaagatgtggcaaaaggactcggccaaaaaacaggcctgctgaaatttgtgatggcgctttgtgttgtcatgcttgcagggtccgctgtcgccattgccgggccgatttcttttatcggcatcattattccgcattttgcccgctttgtcgttggtaatgattatcgctgggttctgccattttccgctgttttgggtgccattttgcttgtttgcgcggatatcggtgcgcgatatatcattatgcctcaggaagttcctgtcggggtcatgaccgccatcatcggaatgcctgtgtttgtgtacatcgcaagaaggggggcgaagctatgaaacttcgttttggcgttactgcggctgaaaagaaagcatggatcgtctttttaattttactggggttaacagctgctgtactcatcataagcgcaggtctcggacaaaggtttattcctccctgggatgtagcaaaaacattctttggtgcaggttccaagctggatgaactgatgatcatgtcgttccgcatgccaagaattttgacggctttatgcgccggtgtctgcttggcagcggcaggcgcgatattgcaggggctcgtcagaaaccctctcgcatctccggatattatcggaataacaggaggagcggcggtagcggtcgtgcttttaatgatgttcttctcagaccgcagcagttcacttacgatcagtctgtcatggcttccagcagccgcatttatcggcgcatcggctgtcgggctcatcgtctatttactggcatacaaaaatggcgcctccacatttcggctggtgcttatcggaatcggattttcaatgtcggcgcaggcgatgactaccctgttgatgatcaaaggcccgatttaccgggcatcacaagccaatgtatatatcactgggtcagtttatgggtcaaactggcagcatgtaaaaatagctattatcttatctgtcattctcttattcatttgttttgtcgcgctaaaaaatatgaatatacaggtgctgggtgaagatattgcggcgggtgcaggaagcgctgttcagcgaaatcgttttttcttgctacttttgagtacggctcttactggttgtgcagtttcagttgctggcacaatcggttttgtcgggctgatggcgccccatattgcaagacggcttgtcggctcatcttatggcgcgctgctcccagcgtcggcacttattggagctctgctcgttttaacagctgatatcgtcggcagaaccttatttgctccggtggaagtgccggccggcgtctttacagcggctatcggcgcaccttattttatttatttgctctataaaacaagaaattcttgatcgttacacccattttcttaaaaaagaaaatgggtttttttgataatgactgaagattcgtaattatttttgctatactgacagagacattgataaagaaagggcggcagatgaatgaaagaagcagaggtattaaaatatgaagcatttacaagcagtcccggcaaaggaaaccccgcaggcgtcgttttgcggggagacgtttatacggaagacgagatgcagatcatagctgagcgtgccgggtattcagaaacctcctttatccgaaaaagtgagtcggccgatcttgaactccgttactttacacctggacacgaaatgaatttgtgcggtcatgcgacagttgcgtctctttacgcattatgtgagaaaggaatgctggagagcggtaaaacgtacagcatccaaacgaaagcgggtatcctgcctgtgaagatttctgaaaaagatggccgtattcatatcacgcttgaacaggcctctccgcaattcaaaccatttacaggcgatcggaaaaaacttgcggacgcactgggtatcaccgaagaggattttcatgaagaccttccgattgtgtttggcagcactggcatatggacagccatcgttccgcttaaatcattggaggcttccaaaaaaatggtgccagataacaaacaatttccggaagtgttaattgatctgccaaaagcttcagtccatccgtttacctttgaaaccgttcatcccgacagcgacctgcacggacgccacttttcatccccgtattcgggaacgattgaagaccccgtgaccggcacagcatccggcgtgatgggggcttatatgaaacattatggcaatgccgagcagcataaatttatcattgaacaagggcaggaaattggaaaagacggaaaagtggagatcgaaatgaacgaagccggcggccatgtgaaagtgaacatgacaggaacagccgtttactcagaaacccgtattcttaaaatctaatacggatgatggtttacaaaaagatgcactttccgttatcattatgaaatgataatcattttcaattgcataggaaggtgagacggtatgcctcaaaccgaacaaatacatcagcattcagtactgcgggacatcatacgcagcagaagatcgattcgaaagtttaaacaagagccagtaccttcagcagtcattcttgacatgcttgaaacggcaaaatatgcgccaaatcacagagtgacagagccatggagatttatttacgtttccagtgagacaggtaaagcgaacctcatcaatacatttgcagcgttctctaagaaatccaagccggatatgacagaggaaaagcttcaaaatttcaaaaacacacttgggcgcgttccgggatttctcctcgtcgtgtttcaggaagatgaaaacgaaagagcgcgggacgacgattttgcggcaacaagctcgttgattcaaaatcttcagcttcttgcttgggaaaaaggaatcggcatggtttggaaaagcggaaaaatcctttatgacaaagaagtccatcaggcctttggtttgcaggataatgagcgtttcgccgccatcatacaaacaggttatcctgacgaggcgccggaagtgaaaaaacgcacaccgatccgcgaccggttcactgaaatgtaaaaaaccccttgtctcaaacggagacaaggggtttttcattaacgagatttctttttcgctctgttgtcggctgctttcgcacgctcttgcgcttcgcggtcatctgcatcagcaagctcggttgaatattcttcgtaaacgccgtcagtttccctttttaatgcatcgggaacttgtggaagcttttgtttgtttttatcacggtttttgtggatatgatttctgcccatatcaaattccccctaaaagtgatatcaaacaaatatagtatttggttttaaggggctatgtattcctacttccgcttagcagctttttccgcttttttaaattcgcctgaataaagaacttcctgcattttcttcaggttggcgccttgctgatgcttctccctctttttttccataaaaaggacctccttcaaccatgttattcttaaggttgacccttcctgctgtttttatacagtctttcggtctgctatcagctgtgagagtgcaaattcaagatccgaatatgtaaaacgaaatccagaggttatcgcttttttcggaagagcgcgctgtcctttcacaatcaaaagactcatttcacccaatgcttttgataaaaagaattccgggacggggagccagtgcgggcggtgcttcacccgtgcaatcgtttttccgaattgcttcatgtccacaggattgggcgcggtgacattcattgggcctgagatgccggcgttttccaccgcatatcggatcaactgggccgcatcctcgacatgaatccatgacagccactgccttcccgttccaatcgttccgccggccagaaacttataggggagaaccataagcggtaaagcgcctttttctccaagcatcacgccaaatctcgcataaactgtccggatatccatcgcttcaatatgctgtccttccttttcccacaggtgtgcagtatggctgagaaaatcctcatctgacgttgcagaatcctctgtgaaagttttctcaaggcttgtgccgtaaatgcccacggcactggcttggatcaatgtcttcggcttctccttctgtttctgaataagccgctgcacttcacgcgtcgcattgatacggctggagagaatgtgctgcttcgttttttctgtccagcggccaaaaatcgattttcccgcaaggtttatccagacatcaatatgaggaagttcctgctccggggtggctccttccgtcagccattggacatatgtcatatttttttgttcagtttcccttgcgtttcttgataaaatataaacatggtgtccctggcgggtaagaacgcctgtcagatgctggccgagaaaaccggttccgcccgtcattgcgatattcatgaacatctctcctcatcgttctaataaatatactttacctcattgtaataaaagaaaacgcatttcaggcctgagaagggagattaagatgccgtttattacaaaaatatcaacgcaaaaaaagaatacggaacgcttcaatatttttctggatgataaatacgccttcagtgtggacgcggatgtgctcgtgaaatttgagctcaagaagggaaaagaactcgatgatcttgacatcattgagattcaatacggcgatgaagtgaagaaaggcttcaaccgtgcgcttgactttttatcctatcgaatgcggtcgacgaaagaggtcgaggactacttaaagaaaaaagaaacctcgccccccgtcattgcggaagtcatccataggcttaacgattacaagtacttaaacgaccaggaatttgccgcagcctatgtcagcactcacaaaaaaacaaacggaaaaggccctgatgttttgttcagagagctaagagcgaagggaattgatgacgatacaattaaggaggcgctaagttccttttcctttgaagatcagataagagaagcggtcaagcatgttgaaaagcttctcaaaaaagataaaaagctttcgacgaaagaactcaaacagcgcgcccagctgcagcttcagcgcaagggcttctcatttgatgttatcagcgcggcgatggatcagattgaatatgaaaatgatgaagacacagagaaagaagcgctgcgccttcacgcggaaaaagcgtttagaaaataccgctatgacggctcatatgaaagcgccatgaaggtcaaacaatttttattccgcaaaggattctcactcgatttaatcgagcaattactgcaggaagaggagtactgaaatggagaaacgatacagtcaaatgacaccgcacgaactcaataccgaaatcgcattactttctgaaaaagcaagaaaagccgaacagcatggaatcataaacgaactggcagtgctcgaacggaaaattacgatggcaaaagcatatttgctgaacccggaagattactcaccgggagaaacatatcgtgtggaaaacactgaggacgagtttaccatcagttatttaaatggcgttttcgcatggggatacagaacctcttcccctcagcaagaagaagcgctgccaatctcagtattgcaagaaaaagaataaagcgtaacaggaggctgatgatcagcctctttttgtttgcagcattttcacacgaattcttaaagaaaaaatcattgaattcacttgaaaaatcttttaagatgaaactcgttgttttttaaaatcaaaggaggcgatgacgttgagtatcaaaaacccatctgtaaaatttattatctttgttcttatgatttgtacattttcaatcggctatacagaatacgcggtgatgggtattttgacgtcgattgccaatgactttcatatacaggtttcatccgcagggcttcttgtcacggcttatgcggcaagcgtttgtttgacagggccgctcgtcaccatcatttccgtcaagcttccgagaaagcctgtgcttcttgggctgatggcgatatttatcctttcaaacctgatgagcgcactggcgccgaattttgcggtattggccatttcaagaattttatctgcgtccattcacggtgctttcttcgcgattgccatggtattcgcaagtgaaatggttccgccggaaaagcgtgctgcagctgctgcttcaatgaacggcggactgacagtggctctaatggttggtgttccattcggctcttatctcggagatgtcctgaattggagagcggtgttttccatcattacggctcttggtgtcatcggatttttaggccttatggctgccgtgccgaacagaaaaccaaaagtgatcccaatgcttatgaatgagtggggggtttttaaacacaaacaagtgctgttttccttcgcgattaccattttaggctattccggtgtctttatcgcctacacctttatcgaacccattttaaggcattcagccggattcagcacggttggcattacaggtgctctctttgcgtatggattgggaggcgttgccgggaatttctttgctggaaaagtaccgctgcctttgctgactcggacgatgatcggcgtaatgatcggtttaatcggtgttctggctgtatttccttacatcgccatttacccggctgcagccattgtggcaacgttcctattcggggcatgcgcattcggcacgccgcctcttctgcaaacaaaggtcatttcctcatctgagggcggcacaaccattgccgcagctgtcagcgtatcagcatttaaccttgccaatgcccttggtgcatggatcggcggaatgattttaaacggaacaggctcttattcctggctgtttgcaggaggtgcgcttatgactgcatgcggacttgtgctttctaccttcgcacacttatcagaaaagaagagcgtctacgaatatcaagtcaataaagggtaaaaacagctgcagtgtatgcagctgttcttctttaccgtttgcctgaggctctcattctttcttgaggatgctgattgatagatccgtcagcacgctttgaagcatagtcgtcctttgctctcggttcaccctgaaatttgttttcgttttcgtaaggaaatcctttttctttatttcggaccatgtcatatccccctaggttcgagatcaaaaagttgcgtctttccagatgaagacgtaaggttagtatatggagaacaccacgtaataaagcgttatttttttcctgaagaaaggagactgcacacatgaatatgtacattgagaaactgactaatctgcttctggaaaagaacgagatgatcagctatatacaggcaaaaacgtgggtggaattgttatggagcgatttcgaagcaacctatgcaaaagccggacacgcctatcaaggtgaaaaaatgactgaaaaaatcgtcacacaatggattgaaaactatggcggccagctccacctttttcaaagctcccgtaacgacgtgaatgattacttaaatcaaagcagaggccttttgcactaaaaacctgccgttaacgaccggcaggttttttcattttcttaaaattaccttaaaaggaagaaatcataaacaaaacatgtttcaccagcctgtcaatcagggaataccactaatatcttgtcaaaatgcgaggaggagctttatatgaaaaagaaacaagtaatgctcgctttaacagctgccgcaggactgggtttgacagcacttcattccgctcccgcagcaaaagctgcgccccttcacgacatatctgtcagcatgccatcatccgattcttacatcataaaaacaggaaagctgaatgtccggactgagccaaatcataaaggtgacattctcggcactgtatcatcagaacaagaagtaaaagtctatggatttgtaaatgccgattgggctcaaattcatttcaaaggaaaaaaagcgtatatttcaacccactttttaatgaaaaccgcaagccaagcgaaaacaatgaaacagacagccttctatgcaccgacgcccgaaaatggaaaagctaaacagctcccatctggaacagaggtgacaatacttgggtggggattcagtgaaaacggcggatttgacttcacttgggcgttcgtggattatggcggagttaaaggctatattcacacaaaggatttacaaatgcgataaaaaggcaggccgaggcttgtctttttgcctatgcatgaaacatttcttctttctgcacgtaacaatgagaaaggagatgatgatatgacgggtttagtcggcggagggcttatgatcattgcgggcatactgatcaaactgtttcctcccaaatcgatcaacagtgtgtatggatacagaacgagacgctcaatgtcagatcaaagattatggaatgaagcgaaccgttacagtgcatcattaatgatcctgtcaggcttggtgattgcgggaatgggtttgctgctgggatcaaacttgattattcttcagcttatcctgctgattgccgcctgtgtcataacatttatgctaacggagaaaaggctgaaaatcatgacgcacagtcaaggaggagattgaagtggacggagttaaatgccagtttgtcaatacgaacggaatcacgctccacgttgcagccgcaggaccggaagacggcccgttaattgtcctgctccatggatttcctgagttttggtacggctggaaaaatcaaatcaaaccgcttgttgatgcgggttaccgggtcattgctcctgatcagcggggctacaatctcagtgacaaaccggaaggaattgattcgtatcggattgatacattaagagatgatatcatcgggcttattacgcaattcactgatgaaaaagcaattgtcatcgggcatgactggggaggggctgttgcatggcatttggcctccacacgcccggaatatcttgaaaaactgatcgcgatcaatatcccgcacccgcacgtcatgaaaaccgtaacgccgctttatccgccgcaatggctgaaaagctcgtatatcgcatacttccagctccccgatataccggaggcatcactaagggaaaatgattatgaaacattagacaaagcgattggattatccgaccgtcctgcgctttttacatccgaggatgtcagcaggtacaaagaagcgtggaaacagccgggcgcgctgacagctatgctgaactggtacagagccctcagaaaaggaagcttggcagagaaaccctcttacgaaacagtaccttaccgaatgatctggggaatggaagaccgctttttgagcagaaagcttgcgaaagagacggaaaggcattgcccgaatggacatctcatctttgttgatgaagcttcccattggattaaccacgaaaagccagccatcgtcaatcagctgattttggaatatcttaagaaccaataagccaaaatttctctccatccgtctgtcataatggcagactttttctgtgcgtttttttcatagtctgttttaaacatgacaaaataacattaaaaatcatgaatgtcaccataaaattgtaacaaaaaacaggtttaaacgactttaaaaaaaggaatagccttactgaagatttgtgtaaaactcccctaaggcaatacttaaaaagaataaaaaaagaaggtgccttaatgaagcaaggattaatctcgattattatcccgtcttacaatgaagggtataatgtcaaactcattcatgaatctttaaaaaaggaatttaaaaacattcattatgactatgaaatattcttcataaacgacggaagtgttgatgacacgcttcagcagatcaaagacttggcagcgacgtgcagccgggtaaaatatatatctttttctcgaaactttggaaaagaagccgcaattttggcgggctttgagcatgttcagggcgaggcggttattgtaatggatgccgatctgcagcatccgacatatttgctgaaggaatttatcaaaggctacgaagaagggtatgatcaagtcattgcccaaaggaacagaaaaggggacagctttgtccgctcactcttatcatctatgtattacaagttcattaataaagcggtggaagtcgatttgcgtgacggtgtgggtgacttcagattgttaagccgccaagctgtgaatgcacttttgaagctgagcgaaggaaatcgcttctcaaaaggtcttttttgctggattggctttgatcagaaaattgtattttatgaaaatgtcgaacgaaaaaacggcacctccaaatggtcgttcagcagtctgtttaattacggcatggacggcgtcgtttcatttaatcataagccgctgagattatgtttttatacaggcattttcatcctgctgctttccatcatttatatcattgccacattcgttaaaattctgactaacggtatttctgtgcctgggtatttcaccattatctcagcagtgttatttctcggcggagtacagctgttaagccttggaattataggtgaatatatcggccgaatctattatgaaacaaaaaaacgcccgcattatttgatcaaagaagcgaatatcccgaacaaagacctgcctgaaacgaacgaattaaaaagcatgcggcgtctgacaaaaatgcactgaaaataccaagcgccattggcagtgctttttttgcgtgtctattatcttaaaagcaagactggagaattcatatgaaaagaaaacatatcatgatctatgcggccagtttgctggtgtccgttctggcacacgctttttttgtgaaagaatgggcggaaggcaggtatatgacaggtccgggtgacgggcttgcgcaaatgatcgtatttaaaaaattattatttgaccaatatacacacgggaattttttctacaattattcattcggacttggcggcggcacattcagtcagctcggctattatttttctgcgtcttttctttttcttgctgtgtccgccgctgtttggatgcttcaagccgtccagctgatcggagaagcggatacgcttttttgggctgagtcagctgtttttatcagtattttcaaattgagcttgatcatctttacgtccgcttctgtttttcattatcttctcaagcacagggcggcatcgttcacgggagctgtgttatacggcgtctcaattatttatttccgtcacgaagcgtattgggaatttttcaccgatacaatggtttggcttccgctgcttgtgcttggcgcagaaaaaattattagagagcggcgtccggcgtggtttatcgttgcgtgttcgctgacgttaatcaataacttttactttgcatacataaaccttatattcatcggaatctatgtgctgttcagatggctgatccgtttggaaccacatgaagagaaaagatggattcaaatcagattatttctcgtttcaggcttcatttcttttggcatcagtgcggcggcgtttgtgccggtagtatacggttttttaaacaacctgcgccctccatacagccagaaaatagagtggctcaatttcgatgataatatcttattttcgagccggatcatcattgtgccggccgcttttctgctgtttttgtttatgatttctttttacaaaaaccgtgtgtttcgtctctttgccgggttgagcctgctgtttattctgtttcatttcagtccgtatgcggcaagcgtctttaacggtttttccgccccgcaaaaccggtttgaatatgttctggcctttaccattgcgggagcagctgcggctggtttgtcacagctgtctgaattgaaacggaaagaactgctcccggccgcagctgtcgtcctgcttctttacttgtatcatattcaaaggtataagctcgatatatggaagcctgcgaatgaaagtattctattgctcttactcatgacaatcgcagccttgtttgctgcagcttttgcgaaaaaacgggcaaaaatggctgtgtacggtataatcattctttcttcgctgtttgtcgccaactcctatcaaaaatacgcgctctcagaaggcggcgatttggatagtgtgacaaaagaatatcttacaagtgaggaatacagagggcgggaatcatctgagctcatcagacgtttacagaaggaaaacgatgatccgctcatgagaatcgactggatgaacggggtccgcaataatacgccaatcatttacgggtttaatggcttcagcgcctattccagcattttaaacaaagatctgctggccttctattggaatgatttaagcatcgatatgggcagggaaagcgtcagccgttacgcgtcattgggagacagggcgaatttatacagcctgctttacggcaaatattatatgaccgaaaaaacgaacgaagccagcgttccgtacggcttcaaaaagcatttagaaacagagcattatgcagtttatgagaatcagtacatgcttccattcgtcaaaacagcggatgccatatacagcgaaagtgagctggaccgattgcccgctcttgcgaaagaacaggcgatgctgaaaggaatcatattaaaagatccatcaggaaaaacggagcagacaccaaaaccgtccaatttgatcaccaagtcggacatcaccgcaaaacaagcccagtatcaaaaggggctgctaaccgtaactggagaaaacggaggagaactgatcatcaccccgaaacagccatcatctgctccgggagactactatgtcagcttttatttgaaaagcaaagcaaaagacaaaggatttacgttaaaggtaaatgattatgtcacaacaaggaaatcgaacaaatcgatatataaaaccggagtaaataatataacggtaagagtgcctaaatcacgccatatctcaatcaatcttccgaaaggaacctatgagctgagaaacatagcgctctatgaagaaaattaccaaacgctgaaaaacgttgtaatgcaaaataaaacagagaaagcagacaaactgaattggaacaaaaatcgactgacctttgcctatcatctgtcaaaagaccagtacatcatgcttccgatcccatatgaaaaaggctgggagctgaagatcaatggaaaaacacagaagatcgaaaaagctgattatgcttttataggcttcaaggcgcaaaagggagacaatcacattgagctgacttactatccgccatacttcaaaatatcggcgatcatatctctcgtcagtctgctgcttgctgttttctatataagacgtaaaaagcccggctctatatagagccgagctttaattttttctgaagtttttcttcgctgaatatccatcccgtataagacgaacgaatcgtgagatcatggccgatatgaacaattgcgacaaacggataatggcctttgctccgataacgcaggtcgataaatctcacctcataatgatctttaaacgtatccacttcccaccggtaaaccggagaaaaggacagaaacgccgcgatgttatcatcctgctttgccgcatgcattacatcggtttcaggaacaggcacccgattaaatgtatccagaatcacgacatgtccttccatgcttcttcctacatagaaagcatgtgctgtcgtcactgcgattcgccattgcctgaatttcatcgttggagaaataataatgctttcgatctcatcatgaatcatctcatgaagcttccgtttaattctcagctgcatgatcaggcgcaccaagtaatagcctgccaatatgatatataagctgagaaacgtgatgccgggactcccgcctgcataccaaatcgcgatagctgctagatggctgataaaaataaacggatcaaacgtattaatcagcccgagcgcaacccattttttcgaaaacggacgaatggcttgtgttccataggcgttgaatatatcaacaaagacatgcagaacgactgccagcagtgtccacagccacaggtgcagaaaatcggcctgaggataaaataaatacagaatcgccgggatgatgacagaccaaaacaaaacggcgggaattgaatgggtaaatcctctgtgattccttatataaacagcattgtttttaagctttaacacagtatcaatatccggagcctgagagcccgcaagcgttgcgatcataacagcgtgagccattgccggatctgatccgacaacaggatcaagcgtcgcaataccgcccagtgcgatgcccataacgacatgtgtgcccgtatccataggtgacctccttgcaggatgatcctgcacattcactttgtaagaaattccccattttcatatacccaatttttaaactgattcaatcgttctcatatgtttccgctttttctttattactatttaatgtaacatattatcgtactgtgcccttagtgtacaacaaaaaacagtctaaagaaaagcggggcgcgaaagactggggagaaacacatatgaacgtacttgaagacaaattaaaacaaaaagacatacagcaatttcgcgatgatttaatctcatggtttgaacgagagcagcgcgttctgccgtggagagaggaccaagatccttataaggtatgggtatctgaagtgatgctgcagcaaacgagagtagagacagtgattccttactttctgcggtttgtggaacaattcccgacagtggaagcgctcgctgatgctgatgaagaaaaggtgctgaaagcatgggaagggctcggctattattcgcgagtcagaaacctgcaaagcgcggtaaaagaagtgaaacaggaatacggcggcattgtccctccagacgagaaagattttggcgggttaaaaggcgtcggcccttatacaaagggagcggtgctcagcattgcctacaataaacccattcccgcggttgacggaaatgtgatgcgtgtcatgtccagaattctttctatttgggatgatattgccaaaccaaaaacaagaacgatctttgaagacgccatacgagcttttatttccaaagaaaaaccatctgaatttaatcagggcttgatggagcttggagccttgatttgcacgccaaaatcaccctcatgcctgctatgcccggttcagcagcattgctcagcatttgaagaaggcactgaacgggagcttccggtaaaaagcaaaaagaaaaagcccgggatcaaaaccatggccgcgatcgtactgactgatgaagacggacaagtgtatatccacaaacggccgtctaaaggtttgctcgccaacctgtgggaattccctaatcttgaaacacaaaaagggatcaaaactgagcgtgaacagctcattgctttcttagaaaacgaatatggcatacaagctgatatcagtgatctgcaaggtgtagtcgagcatgttttcacccacctggtatggaatatttcagtgtttttcggtaaagtaaaacaagtgtcggataccagcgagctgaaaaaagtaacgaaagaagagctcgaacaatttgcgttcccggtgtcacatcaaaaaatctggaagatggcagtagaagcagccgccatctcggctgctccgtaaaccattcttaatcgtaagagacgcgcgtgccgtggctgtagtccgcttcattgcgcttcattccgccgcgcgcttcaatttcttgcgttaattcccggtattttgattggccttcttcgttcaaataaggcataatttgctgaaaggcatgatggaaataagcgagttcactgttcttccaatcttttttggaaaccatgttcaattcgctcatatcacgtccgacatacataacagaagaccccctttaaagttcttgccattattgtttgtggaaataaaagaactatacgctacaaggagatgaggaaaaatggaacaaaataaatgtgcactcgtaacaggaagcagccgcggtgtcggaaaagcggccgcgatcagacttgctgagaacggctataacatcgtcattaactatgcacgcagcaaaaaagcagcattagaaacagcggaagaaatcgaaaagcttggcgttaaagtgcttgtcgtaaaagcaaacgtaggacagcctgcaaaaatcaaagaaatgtttcagcaaattgatgaaacgttcggcagacttgatgtttttgtcaataatgccgcatcaggagtactaagacctgttatggaattagaagaaacacactgggactggacgatgaacattaatgcgaaagcattgcttttctgcgctcaggaagctgccaagctaatggagaagaacggtggcggacatattgtcagcatcagttcattaggctctatccgctatcttgaaaactacaccacggtcggtgtatcaaaagcagcgttagaggctttaacccgttatcttgccgttgagctttcaccaaaacaaattatcgtcaatgctgtttcaggcggagcgatcgacacagatgcgctgaagcacttcccgaatagagaagatctgcttgaggatgcgcgccaaaatacgccggcgggacgcatggtcgaaattaaagacatggttgatactgtggagtttctagtgtcttccaaggctgacatgatccgcggacagacaattatcgttgacggcggacgctcactgctcgtttaaaaatttttaaaaaagaggaatagctatacgatcacctgcacattctaatgaccgtggaggtgataacaatggctaactcaaataacttcagcaaaacaaacgctcaacaagttagaaaacaaaaccaacaatcagctgctggtcaaggtcaatttggcactgaatttgctagcgaaacaaacgctcagcaagtcagaaaacaaaaccagcaatcagctggccaacaaggtcaattcggcactgaattcgctagtgaaactgacgtacagcaggtaagacagcaaaaccaatctgctgaacaaaacaaacaacaaaacagctaatcactgaaacagaaaaaagcacttcatcttcgggtggaagtgcttttttctgtttgaaaaacgacaaaacttgtggaaggtctacagaatgagtcaaagggtttgctttatggagatcgaaatgattaaaggaggaaatgtttatactttcatcaggctgaaggaggaaccgatgacggaatttgaaaagctggtaagtgaacagatgaaaacgatggataagcttctcgatctccaatcagagctcgaccgctgcaaacaaattgaggcggaactccggcatttggaaagggatgcaaagctgcgtgggattcaggctgaaattgcggtaaaacggaaacaccttgccgatatacaggatatgtttcaaaagcagacagagcaggtcattcgttcatatcgcagctcagaaaagccgtcttcctttgtgtagtgcaggaatgtgccattccccggccggaatggctcttttattttcatttttcaatttgtaacgttataataggtaaaagacgttgtcggtaagcaaatttggacatactaactgtagggctttatagaaagtaggggagaaatatgggctatcccaaggaaggagaaaccattcaaattcacagctataagcacaacgggctgattcatagaatttggaatgagacaacaatcttaaaaagtacagaaatgtgtgtcatcggagccaatgaccggacgatggtaaccgaatcagacggccggacatggataaccagagagcccgcaatctgttattttcacgcaagacaatggtttaatgtcatcgggatgctgagggaagacggggttcattattattgcaacatcagttctccgtttgcctatgatggcgaagcaattaaatatattgattatgacttagatgttaaggtttttcctgacatgacctacaatattctcgatgaagacgaatatgatgatcatcggaaagccatgaattatccaaaagaaatcgacagtattttaagagactacttaaatacgctgctccattggattcaccagcgtcagggaccgtttgcgcccgagtttgtcgatatgtggtatgaacggtatttgcgctacacaaaataatggttacgtaaaaacctgttgcggggtacaacaggtttttcacatgggctcacacacatcatgataaagagagagggggaatcaacgtgggggttatgaaacgctacatgcaattcgtcaaaccttataagaagcaaattttcgttacagtgttaatcgggatcgtaaaattctccattccgcttgctctcccattgcttctgaagtacgtagttgacgacattattcaaggaggcggcacggctagtgacaaaacaacgtcattgttcacgattatggcgatcatgttcgccttatttttaattttgcgcccgcctgttgaatattaccggcaatattttgcccagtggactgccagcaaggtgctttatgacataagagctaagctgtttgaccatatacaaaaactgagcctgcgtttttacgcgaatacaagaacaggagaagtcatttcccgagtgattaatgatgtagaacaaacaaaggatttcgttatcacagggctgatgaatatatggctcgatatgctgacgattttgattgtaatctcgatcatgctcacactggacgttaaattaacgctgatctctatcgtattattcccattatacggaatatcagtgaagtatttttacggccgtttacgaaagctgacaagggagcgctcacaggctcttgctcaagtgcaggggcatttgcacgaacgcattcaaggcatgcctgtcatcagaagctttgcgatagaagatcatgaacaggctcaatttaatgagaaaaacgggcatttcttagataaagccatccgccacacgaattggaacgccaaaacctttgcggtcgttaataccattacagatttggcgccgctcatcgtcatagcgtgcgccgggtattttgtcattaatggaccgctgacagtcggaacaatggtcgcgtttgtcggatatattgacagaatgtacaaccctgttagaaggctgatcaattcctctacaactttgacacagtcaatcgcatcaatggacagggtatttgaatttattgacgagccctacgaactcactgacaaaccaaatgcgataaaggccgatcagattcgcggaggagtggagtttcaaaacgtttcgtttcaatatgagaaggacaaagaaaatattcttcatgatgtatccttaaaagtaaatagaggagaaactgtagctctcgtcggcatgagcggaggaggaaaatcaacgctcgtcagcctgatcccaagattttatgatgtaacaagcggcagactgctgattgatgggacggatattcgcgattatgaagcaagaagccttcgcaaccaggttggtatggtgcttcaggatacctttttatttagtgaaacgattcgggaaaatatcgcgatcggcaagcctgatgccacacttgaagagataatcgaagccgccaaagctgcaaatgcccatgaatttatcatgagttttccagaaggatatgagacccgggtgggggaacgaggcgttaagctttcaggcggacaaaagcagcggatctcaattgcgcgggtattcctgaaaaatccgccgctcctcattttagatgaagctacatcagctctggatttggaaagtgagcattacattcaagaagcgatggacaaactggcgaaggatagaacaacttttgttgtcgcccaccgtttatcgacaatcacccatgcggataagattgttgtcatggaaaacgggacaatcattgaaatcggaacccatgatgaactcatggactatgagagccaatacaagcacttatttaccattcaaaatttgaactaaaacatcaatcttatatccttttaacgaaggatataagatttttttgtatataaaaaaacccggctgtttaaccgggttactcttctgtttctatttcgcagtctttcggatgatacgtttgaaaacttgtgataagtgtttctaaatgttcaagctgctcgcgatattccacggcgcttgccataatattgagcatgttgtaatcaataagctcctcatccgtattctgctgattttttaaaaatgactttgttaaaagctgcttataccggatgccttcttcaaccgcgtcatcatgcggcttgatttttccgacaaacctcatcaaaatccgttcgtgccagtaaagcaggtaatcaagttcttcagtcaatgtttcctgaaactcttccggcatatgatagatctcgttttccagacgatgcagcttcttcaatgtatcaagcgcccgatttgcagtaataatggcctgtctgaacaggacaagctttcttgatttcacataagtcgttttcttaaagtaacttctttcttctttatatagaagatatgtctgatcaagcttgatcattttttctttcagtttttcaatatcctctttcaaaatcgaatgctctgtcgactgccgcatggacaatctgatccacttcataatttcttcggtgttttcgacggtattatgaatcagctttgtttcgtacttaggaggcaaaaacacaaggttgacgataaaggaagaaagcacccctaagatgactgtgcttgttctgatcagcgcgaacattaaaaagtcgtcaccggcagattctaatatcgcaatgactgttacaagagcaattgaaattgtatgttcaattttaagtttcagcatgattgtaatgacaataactgctgttaacccgatcataatcgggctgggtccgaaaataaggccgaacactgtggcaatcacagctccgatgatatttgcttgaacctggtcaataataatgagaaaagagcggtaaatcgacggctggatcgcaaatatcgctgcaattccagcgaaaatcggcgcgggaagcccgatccacgaagccaaataaagggcaagtgtaatcgcaatcccggttttgaaaatgcgggcaccaagtttcattggtttgtgcgtgcattcctttctatagtaaattgtgtgacatagcaaatgggctaatccttaaaattcccggttagtttatttgctaaacaattaagtaatatacagggatcgatacaaatattcaagctatttttctagaaaaagaccaaaatcttacacgctgtttgattccataaaaaaaacaggagctcaaagctcctgttcaaggtatttgattctagttttttagatgtttaaatgcatcctcgaccgctgcaagcgtgtctttaatatcctgctctgtatgtgctgtggtaataaaccaagcttcatacttagaaggtgctaaattaattccgcgttccagcatcagcttgaaaaacgtagcgaatgtttctccgtcactccgttcagcctgctcgtaattttccactttctcatcagagaagtataccgtgagcgcaccttttaaccggttgaccgtaatggtgatgccgtgtgtttctgcgtgcttcaaaatgccttcctcaagcatagcgccaaggtgatcaagcttttcatacacgcctttttctttgagcacttccagacaagcgatgcctgataggatggaagcggggttccctgccattgttcctgcctgataagcaggccctagcggagctacctgctccatgatttcttgtttgccgccataggcgccaatcggaagtccgccgccgataattttcccgagtgctgttaaatctggtttcacctgtaagagatcctgcgcgccgccatacataaagcggaaagccgtaatgacttcatcgtaaataacgagagcgcctgcattatgtgtcaattcatttactttttctaagaagccctctttcggctcgacgataccgaagttgccgacaatcggttcaacgagaactgccgcgatttcactgccccatttatcaagagccgctttatagctatcgatatcattaaatggtactgtgatcacttcgtttgcaatgcttttcggtacaccggctgagtctggtgtgccgagagtagacgggccggagcctgcggcgacaagcacaaggtccgaatgcccgtgataacagcccgcaaatttaatgatttttgtccggcctgtatatgcgcgagccacgcggatggtcgtcataacggcttctgtacccgaattgacgaatcttactttgtccatagcgggaatggcttctttgagcatctttgcaaatgtaacctcgtgtttcgttggtgttccatacaatacaccgttctctgccgcttttttaatcgcttctgtaatatgcgggtgggcatgtcctgtaataatcggaccgtacgccgctaaataatcgatgtatttgttgccgtccacatcccaaaaataagcgccgcttgctttctccattgcaacaggagaaccgccgccgactgctttatatgatctagacgggctgtttacaccgccgacaatgtgctgtaatgcctcattgtgaagttcaattgattttgtatgcaagaataaaaacctcctatatctccatgcgtcctttctattgtagcatgcttccgaacaagaacaatggcttcgggcttcagattcagctgagatggttgtaatctggacaagaattggatacgcttaataaaaaaacatccggaggtaacgtaatgactatagaaatcggacaaaaagcgcctgatcttgagttaaaaggcgatcatggggaaacagtaaaattatcggattataaaggaaagtacatcgtgctttatttttatccaaaggacatgacaccgggatgtacaactgaagcatgcgattttcgggacagtcacgaaagcttcgccgaactggatgccgtcattatcggcgtcagcccggacagccaggaaaaacacggaaaatttaaagagaagcataaccttccatttctgcttcttgttgatgacgagcataagctggcggaagcgtttgatgtgtggaagctgaagaaaaacttcggaaaagagtatatgggaatcgagcgttccacttttttaattgataaagaaggccggctcattaaagaatggagaaaagtaaaagtaaaggaccatgtagccgaagcgcttcaaaccctcaaagatatgtcggaaaagtaagtctctatgagcctatgcttacttttaccctgatatcaattgacaaattatcgtagaaagagttacactaattataaacattacaatgtaagaattttttttagaagagaggtgcatgacggatggctgcacatgaactaaaagaagccttagaaacgttgaaggaaaccggagttcgcattactcctcaacgtcatgcgattctggaatatctcgttaactctatggctcatccaacagcggacgatatatataaagctctggaagggaaatttcctaacatgagcgtagcgacagtatataacaatttgcgtgtgttccgggaatcaggtttggtaaaagagctcacatacggtgatgcttccagcagattcgattttgtgacatctgatcactatcacgcgatttgcgaaaactgcggtaaaattgtggacttccactacccgggccttgatgaagtggaacagctcgctgcccacgtcacgggcttcaaggtaagccaccaccgtttagaaatttacggcgtctgccaagagtgttcgaaaaaagaaaatcattaaaaataagctgaccgcacgaaacggtcagcttattttatttcgacattttctttttattataagactcatcaaattcttttccttctaatcccttatctaaagtcagcggctctcggcaatgcatgcacatatcgactcttcctaaaacctttgtctctttttcacagcccggacaaatgacgcgaaccgctttggtcgaaagcattccgatccaaaagtaaacaaccgtgctgagaccgatggataaaagtccaagtatcataaacaaactagatagcaaaactgactctttgaaaaagatcccgatgtacataatgataaacccaacgaaaaccaaacttaacgcaaatgttctgattttattaattttgctggagtatttcgccatgtccatccccctctgatttaactatagcacaaactcgatgggattttcttcatgttttcggttgaattggaatttacttatggagacttactgtgaaattgtttataatagttcaatgtgtttagaaaaaaggaatttcgttttaaccatagaattgaatcaaatagagaataaaaaaatttgaacaattgcattggaggaatagtgatggaaaatcttctccgtccaatttaccaagaaagagcaagtcaccccaatacattggctgtcattatgattgagagaagaaacaaaacatcttccttaacagataactttgatgcagctttgctggtaattgtaaaggatgctgatgatccagtttttataaagcattatgaatttgatcatcaaacagcttctttgcatgtggtaacagattctcagattcaagaatggattttgctcggaacaaatagaagaatcatagattggattgtaaatggcagagttttgtttgaccgtaatgaatacgtagttgaactgattgacaggctgaatacatttccgtttgccgaacgtaaactgaagatcggactcgaatacggcaaattaatcagaaggtatgttgaagggaaagctttttttgaagccaatcaatttttagatgcctacaacgccgttgttcatgcgctgcatcatttagcacgtattgaagtaatcgacagaggattccatcccgaaaccacggtgtggagccaagtgcgccagatggagccgcaagtgtacaagttatattccgagctgattgaaagtcacgagagcctggaaaaaagacttgaattattattcttagcaaatgattttctcatccattccaaagccgagatcggttcggcgcatcttttcgaagtaatgaaagaaaaagacatttggcaattcggtgagcttcttcaacatcatgacctaaagcactttacccaagatcttggcgttatgcttgattacttgacagaaaagggacttatcaacgtctgtcagatagaaacgaaaggacaggctgtctatcaccgaggatattcttttaaaaaaggtgttgactctgattcttgaccgtgttatattattaaacgtcgctgatgcgcttctgagaaaacaagctcacagcggcgggaaaataaatcaaaaaaacatttgacaaaagaaagtcaaaatgttatattaataaagtcgcttcaacaagaagtgaaaatgatctttgaaaactaaacaagacaaaacgtacctgttaattcagtttttaaaaaaatcgcacagcgatgtgcgtagtcagtcaaactagggcctgcacgacgcaggtcacacaggtgtcgccgcaggaagcggtgaacttaacctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccacattttgaatgatgtcacacctgttatctagttttgagagaataagttttttcaaaaaaacacttgtttttctcaagaatacatagtataatgttaaatgtcactgaaattgtctggtgatgatggcgaagaggtcacacccgttcccatgccgaacacggaagttaagctcttcagcgccgatggtagtcggggtttccccctgtgagagtaggacatcgccaggcagacttcattccgcagtagctcagtggtagagctatcggctgttaaccgatcggtcgtaggttcgaatcctacctgcggagccattattggagagctgtccgagtggtcgaaggagcacgattggaaatcgtgtaggcggtcaactccgtctcaagggttcgaatcccttgctctccgccacttatacttatacataattacaattgaaagtctgggcccgttggtcaagcggttaagacaccgccctttcacggcggtaacacgggttcgaatcccgtacgggtcattatatgatggaggattagctcagctgggagagcatctgccttacaagcagagggtcggcggttcgagcccgtcatcctccaccattatatcatcgcggggtggagcagttcggtagctcgtcgggctcataacccgaaggtcgcaggttcaaatcctgcccccgcaaccaaattttaaaatggtccggtagttcagttggttagaatgcctgcctgtcacgcaggaggtcgcgggttcgagtcccgtccggaccgccatttaaatacttaggctcggtagctcagttggtagagcaacggactgaaaatccgtgtgtcggcggttcgattccgtcccgagccaccacctatgccggtgtagctcaattggtagagcaactgacttgtaatcagtaggttgggggttcaagtcctcttgccggcactgttttttcaaaatttaatgtggaggggtagcgaagtggctaaacgcggcggactgtaaatccgctccctcagggttcggcagttcgaatctgcccccctccaccatttataggggcatagtttaacggtagaacagaggtctccaaaacctccggtgtgggttcgattcctactgcccctgccaaatttatgacatcttgagattatggcggttgtggcgaagtggttaacgcaccagattgtggctctggcactcgtgggttcgattcccatcaatcgccccatattatcattgggctatagccaagcggtaaggcaacggactttgactccgtcatgcgttggttcgaatccagctagcccagtctcactttttatatcaactgcatataatgtattaagtccatttaaaatgcggaagtagttcagtggtagaacaccaccttgccaaggtgggggtcgcgggttcgaatcccgtcttccgctccaattacggcggcatagccaagtggtaaggcagaggtctgcaaaacctttatccccggttcgaatccgggtgtcgccttcttattgccggggtggtggaattggcagacacacaggacttaaaatcctgcggtaggtgactaccgtgccggttcaagtccggccctcggcaccaattttacttacatggtaagttgaattggtgtttgtgttttatcattataactaatcatattaatgatctacataagtagatcatttttttaatgctttgatttatcataacaagttaagtttcgaggcctattataaagcggctgtatagctagtctttcaacacttttattttatatttccaaaaaaacttttttgaaatacgttgacactttatgagatccatgatatatttatattcgtcggttagatacgacgtaaaacttgccggtgtggcggaattggcagacgcgcacgactcaaaatcgtgttccttctggagtgtcggttcgaccccgaccaccggtatactgaaaaacccgtttcttaacagaaacgggtttttattttttatgcttactcagcgtattggtctaggatctcttctagcacctcttctagctcttctgtatcttcaagctctgattggctgaaacggacgcgtacaagctgttcttcgtcattatacatctcttccagccaccctcggagtcctcttgctctgcggtcgacttcgaaaatgatttccaaaccgtcttcgtctaaaaggaaaatgagttctaattcatcaagcatctgacgataatatccggaagtcggaacgaattcgaattcttgaacgaacggaagacgacgctggaagtagggcgcttgttcacagtctgcttcgttaagacggaagcccaggttttcgattgcttccagcacattttcaatccaagggtgcgcttcaacgaaaatgcggtcatgatcggatttatcgataccgccttgaatgtcaaggtctgtcaccacggcaacctctactttccctacagtcatcggcgtatctagaggcagagtgaatgtgaacggaaattgatgctcttcaccaggctgtatggtaaatgaaccagtgacccggaaagaatgaattgtagcgtatttccggtgctcttcatcgtcttttacaatgacataccgtgtgctaagctgtaaatcgatataacggatgtcctgagcgatttttccgcctttgacatgtaccgttccctgtacttcttctcctggaaaatatgcgtctttttctaaaattgtatctacttttgcagctccaattccggcacttgccgcaagtttcttaaaaaatgacatgttagatcttcccctttttcttttttctcaacagatatacgcaagaaggaggaaaaagattcgtttgattcatacttttttcctattattcgtctcggcctagggacagactaagaataatattgaaaataaaggagtggatggaagtgaataaagaaagtttggttgcagatgaattacacagaatgtttttggcaggtgagctgcaaatcacagtagaggaggatataaacaatatttccgaaaggctgagaaacggcgatctcagtttagaccgattaagcggtgaagacgcgtttataaaagaaacggtaaatgaggctttaagaagagtggagcaataaaaaagagacggcatctcatctttgagatcccgtctctttttgtggtttttgctacaagataaaagtgaatcgatttgaaattgatcacccgagccaccccttttctaacagaaaatctgacagttcatcatggagatacacagctgtatctaattgatcatgcaatgctcttctgatgtggggattttcggcttctgttattgcgacagtgtatttgttaatgctggtttttattgttgttaacaaatcaagaatatctttgggacaaagactttgttcaatgggaaaccaccccctttgtttttttagcagctctgataagaaagtatttggctttgtttcttgcttctatacaaaatgctataataagcaacaaattttgttggggggtgtgatgatgaagcagattattgcgatgggggcgggggtttttcgatggagccggataatttgtccctcgatcaatatatcctcaatcaatcaaaacgagagcagcctcgtatttgttttttgccgacggcgagcggagattcccaaaactatattcagcggttttatcatgcatttcaaacactggattgtgtgccgtctcacttatctttgtttaagccgccatcaacagatttaacttcttttgttatggaaatggacgtgatttatgttggcgggggaaatacgcggaatttacttgtgttatggaaagagtgggggcttgaccagattcttagggaagcatggaagaacggtgtggttttagctggattaagtgccggtgcgatctgctggtttgaagaaggggtgacggattcagccggaccgctgacaagtttgaaaagtttaggttttttgcaagggagcttttgtccccattatgacggggaaaaggatcggagaccggcataccaccagctgatatctaacaagttcttatgcagtggctatgcagcggatgatggggctgctctccatttcataaatgatcagctgtttcagactgtgagttcaaggtcggaaggaaaggcatatcgggtgatgatggctgaacatgaaatagctgaaatcccgttgccggtcaaatatttagggtgaaattggctgaatattatctatattcctctttttttcagattgattttatgataagatgagtgcgaaatcaatagttactgggggtgcccgctttcgggctgagagagaaggtaagcttcttaaccctttggacctgatctggttcgtaccagcgtggggaagtagaggaattgtttttgttattgtcttgctgggcaataatatgtttctttctgactgtaaccgggttcatttatatgaatccggttttttgtgctggttatgggcttgattttgtcctttcaaacgtagagaggggaaggaaaagtaatgcaaaacaattcagtgcagcaagccaacatttccattatgtcaagtttttcaggcagcaagaaggtatacgtggagggttcttcttcggacatccaagtgccgatgagggagatcctattgagtccgacgacgggatcgttcggcgaagaggaaaacgcgcctgtgcgtgtctatgatacaagcggaccgtatacggaccctgaagtaaccattaatattcaagaaggattaaagccgctccgccaaaaatggatcacagagcgcggtgacgtggaagagtatgaaggtcgggctataaaaccagaagataacggttataaaaaagcaaatccaaacgtaagctacccaggattaaagcggaaaccgctgagggcgaaggcaggtcaaaatgtcacacaaatgcactatgcaaaaaaggggatcattacacctgagatggaatttatcgccattcgtgagcatgtgtctcctgaattcgtcagagacgaggtagccagcggccgggcgattattccttcaaacattaatcaccctgaaagtgagccaatgattatcggccggaattttcatgtgaagattaatgcgaatatcgggaattcagcggttacgtcatccattgaagaagaagtggaaaaaatgacgtgggccatccgctggggagcggatacgatgatggatctctctaccggaaaagatattcatacgacgcgtgaatggattatccgcaattgccccgtgcctgtgggaactgttccgatttatcaggcgcttgaaaaagtaaacggcgtagcggaggatttaacgtgggagatttatcgtgatacgctaatcgagcaggcagagcagggagtggattattttacgattcacgcgggtgttttgcttaggtatgtaccgctgactgccaaacggacaactggtattgtgtcacgcgggggagcgattatggcgcagtggtgtctggctcatcatcaagaaagctttttatacacacattttgaagaaatatgtgagattatgaaaatgtatgatattgctttctcacttggggatggtttgcgtcccggatcaattgctgatgccaatgacgaagcgcagtttgctgaattagagacgcttggagagctgacgcaaattgcctggaagcatgatgttcaggtgatgattgagggtcctggacatgttccgatgcataaaatcaaagagaacgtcgataaacaaatggacatttgtaaagaagcgcctttttacacattggggccgttgacaacggatattgcgccgggatatgaccatattacttcagcgatcggagcggcgatgatcggttggtatgggacagcaatgctttgttatgtaacgccgaaggagcatttggggctgccaaaccgtgatgatgttcgtgaaggagtcattacatataagatcgctgcgcacgctgcggaccttgcaaaagggcatcccggagcgcaaatccgggatgatgcgttatcgaaagcccgttttgaattccgctggcgggatcagtttaatttatctcttgatccggagagagcccttgaataccatgatgaaaccctgcctgctgaaggagcaaaaaccgctcacttttgttccatgtgcggtccgaaattttgcagcatgagaatttcacaggatattcgggattatgcgaagaaaaacgatctcagtgaagcagaagccataaataaaggattaaaagaaaaagcaaaagagtttgtcgatacgggaagcaatttatatcaataaataagatgaagatggagaatgctccatcttcatttttttagaaaaacagagagcgtcgaagcggaggaatactctgttcaaagcggaaaacattttctggatcatatttcgttttgacacggcggagtcgttcaacgttttcgccgtaatatgttcttggccagtttctgattttgatatctggccaatttacgtagtctcccatcgtttaactcgaaagtccggatcatcccgtgtcacgatacgtccggtcaattttgtcttttccacacacccacatctctttctctcgtattctagtttctctagcttatgcgtcaggggataagaatgtataaggaaaaagcggggatgcaatctgatatagtatcaataccctcaaaaaatagttgacaggtcggtattgtatgaattaacatggtcagtacaaatttttcaaatttatcgcgctgatcgggacaccgaaggctcttatcttttagataagggccttttttgtatgaaaaaggagggattattgatgggagtcaaaaaagaaaaggggagaaaacgattcaggaagcgaaaaacctacgggaatcagattttgccgcttgagctgctgattgaaaaaaacaaacgagagattataaacagcgcggaactcatggaagaaatttatatgaagattgatgagaagcatatgcaatgtgtaactaaatataaaaaaacccgctgacttcagcgggtttttgcatttctccattaagcatcttttttaatcggcaatccaaggccttctgccacgcgttttccgtattcaggatccgctttgtagaagtgctcgatttggcgcagcttgatttcttctttttctaccggcttcatagcattaacgatattttcaacaaggcgggtacgttcatcttcactcattaaacgatacagatcaccggcttgagtgtagtgatcgttgtgatcgtagcttacgctgtcagcgataccttgtaccggatatgctgcttgcttatcctcaggtgactcttttggaccgccgaagctgttaggctcgtaatacacagatccgccgccgttatcatcaaaacgcatttgcccatcacgctgataattgtttactttgttgcgtgcgcggttgattggcagcgcttgatggtttgcaccgacacggtagcggtgtgcatcatgataagcaaaaagtcggccttgaagcattttatccggtgaaacatcaataccaggcacgagggttccaggtgaaaatgtcgcttgttctacctctgcaaagtagttttccggatttctgtctagaaccatgcgtccgacctcgattaacgggtagtctttttgagaccaaacttttgtgacatcaaacggatcgaaacggtacgtatttgcatcttctaaaggcatgatttgcacatatagtttccatgcaggataatcaccgttttcgattgcgttgaaaaggtcttctgtatggtaatcagggttttcaccggcaatttttgctgccgtattgacatcaaggtttttcacgccttgttctgttttaaagtgatatttaatccatacgccttcgccttcggcatttgtccatttgaatgtatggcttccgaagccgtgcatgtggcgaagtgtcgcaggaattccgcggtcagacatcaggattgtcacttggtgcagtgactctggtgaaagtgaccagaaatcccatacagccgtagggtttttcaggtgtgtttttggatctcttttttgtgtatggatgaaatcagggaacttaatcgcatcgcggataaagaatacaggcgtattgttgccgacgatgtcgtagtttccttcttcagtataaaatttaacagcaaatccgcgcgggtcgcgaactgtgtcagcagagccaagttcaccggcaactgttgagaaacggatgaacaacggtgtgcgtttgccgacttcagaaaggaaagcggctttcgtgtattttgttacgtcgtttgtcacttcaaaatatccgtgtgcgcctgctcctttggcgtgaacaacacgttcaggaacacgttctcggttgaaatgggccaatttttcgagtaaatgtacatcttgaattaaagttggtccgcgagaaccggcagtcattgagttttgattatctccaaccggagcgccccagctagttgtcagtttatttgaactcatgttatcacctcttggaatttataagaacataatatcatctctaagtaaaaagtcaatattattttataattattataaaatagttatctctattaatcgatatctagtatcgaaagtgttggaaagccttgttgtaacagctttttatgacacttaataatttttggagaaataatttttccttctctatttgcgaaacaagcagagtaagtgataaacaaggatatcaaaaatcgtatttaaaaaagagttgacatatcggaataatttgaattaacatgttattcaaacaaaaaaacaattgggcagctgatcggaccgccgaaggctctcatctctacaagaacagagatgggggcctttttgtttttttgaaggcagggttggcagaaagagagggataaaagtggctgtgaccatcagcatcaaagaaaaggcatttgttcaagagggccgcaaaaacacggtcttagagaacatagaattatcaatcgcaccaggcgaatttctaacgcttatcggaccgagcgggtgtggaaaaagcaccctgttaaagattattgcagggcttgattctgaatatgacgggagtgtggaaattaacggccgcagcgtaacagctccgggtattcagcaaggatttatttttcaggaacaccgcctctttccttggctgactgttgagcagaatattgcagccgacttgaatttgaaggacccaaaagtcaaacaaaaggtggatgaactgatcgagattgtcagattgaaaggatcggaaaaagcatatccgcgcgagctgtcaggcggcatgtcacaaagagtagccatcgcccgggcccttctgcgggagcctgaggtgctgcttttagatgaaccgtttggtgcactcgacgcttttacaagaaaacacctgcaggacgtgctgctggatatatggaggaggaaaaaaacaacgatgattctcgtgactcatgatatagatgaatctgtttatttaggaaatgagcttgcgatccttaaggccaaaccggggaaaatccataagctgatgcccattcacctggcgtatccgcggaaccggacgactccggatttccaagcgatcagacagagagtgctgtcggaattcgagaaaacagaagatttggagtacgcagaaggatcagggatatagaaagggcggaagcggaaatgaaaaaaggactcattgtattggttgccgttatttttctgctcgcaggctgtggagcaaatggagccagcggtgaccacaaacaattgaaggaaattcgtattggtattcagcaaagcttaagcccgcttttgatcgcaaaagaaaaaggctggttcgaagatgcatttgaaaaagaaggcatcaaagtgaaatgggtggagtttcaaagcggtccgccccaatttgaaggccttgcggcagacaaacttgatttttctcaagtcggtaattcgcctgtgatcgctggacaggcggcaggcattgactttaaagaaatcggtttgtctcaggacggcttgaaagcaaacggcatccttgtcaatcgaaacagcggcattcaagacgttaaggacttaaaggggaagaaaattgcagtcgctaaaggcagcagcgggtttgattttttgtataaagcgcttgatcaagtggggttgtcagctaatgatgtgacaattattcagcttcagcctgatgaagcagcttccgcatttgaaaacggatctgttgatgcctggtccatttgggagccgtacttgtccttagaaacaatgaaacacggagcaaaaatccttgtgaacggagaaagcacagatttatattcaccgggttttactttagtaagaacaaagttttcagaagagcatccagacgaagtggtccgttttctgaaggtgtttaataaagccgttgtatggcaaaaggaacatctggatgaagcagcggacttgtattctgacattaaagatctcgataaaaaggtcgtcgaaaatgtgctgaaaaatactgaacctctgaatgaggtcatcagtgacgacattgtgaaagcgcagcaggaaacagcagattttcaatttcgaacaaaggcgatagataagaagattgatgtgaaggatgttgtcgataacacttttatcaaaaaagcattaaaggaacattcctcaggaggtgatcaatgatgaaagcagaggctgcgggctcgctgcccaaaacgaatgcggaagcggtgcgaaaaaagcccggaaggaagagatacggctggatgaaggggcttttactgcccgctgtcatcattgccatctggcaggtcatcggcgggctgggggttgtgtccgctacagtgctgcctacacctgttacgattgttctgacctttaaggagcttattttgtccggcgaactgttcggccatctgcaaatcagcatttatcgggcggcgcttggttttttgcttggcgcggggcttggattgatgatcgggattttggccggattttccaaacggacggagctgtatcttgatccgtcgttgcaaatgcttagaaccgtacctcatctggccgtcacgccgctgtttattttatggttcggatttgacgaagtatctaaaattttgctgattgcgctcggtgccttctttcctgtctatatcaatacgtttaacggcatccgcggggttgacgcgaagctgtttgaagtcgcccgggtgcttgaatttaaatggcatcagcagatatccaaagtgatattgccggcagccctgcccaatatattgctaggcattcgcttatcgctcggcattgcatggctcgggctcgttgtggcagagctgatgggctcaagctcgggagtcggctatatgatcatggatgcgagacagttttcacaaacgaataaagtctttgcagggattatcatttttgcagtggttggaaagctgacggattccttcgtcaggctgcttgaacgaaagctgttaaagtggagaaacagctacgaaggataaaagatataaggggagatgaatatggaaattctttggtttataccgactcatggagacgcgagatatttaggatctgaaagtgatggacggactgcggatcatctttactttaaacaagtcgcgcaggcggcagacaggctgggatatacaggagttcttctgccgacgggaagatcgtgcgaggacccgtggcttacagcgtcggcactggcaggagaaacaaaggacttaaagtttttagtcgcggtaagacctggtttaatgcagccttctctggcagccagaatgacgtccaccctagaccgcatttcagacggccggctgctgatcaacgttgtggctgggggcgatccgtatgagctggcaggcgatggcctgtttatcagccatgatgagcgctatgaagcaacagacgaatttttaaccgtttggcggagccttttgcagggagaaacggtttcctatgaaggaaagcatataaaagtggaaaacagcaatctgcttttcccgccgcagcaagagccgcatccgcccatctatttcggtggttcgtcacaggctgggattgaagctgccgcaaagcatacagacgtgtacttgacatggggtgagccgcctgaacaagtaaaagaaaagatagaaagagtcaaaaagcaagcggcaaaagaagggagatccgttcgatttggcattaggctgcatgtcattgcccgtgaaactgaacaagaggcatgggaagcggcagagcgcttgatcagccacttggatgatgacaccattgccaaagcgcaggcagctttgagccgttacgactcttcaggccagcagcggatggccgtccttcatcaaggcgatcggacgaagcttgaaatcagcccgaatctgtgggcggggatcggcctggtcagaggaggggcaggaacagctcttgtcggtgatccgcagacgattgccgaccggatagcggagtaccaggcactcggcatagaatcgtttatattctccggctatccgcatttagaagaagcgtattattttgcagagcttgtatttccgcttttgccgtttgaaaatgatcggacgagaaagcttcagaacaaaaggggagaagcggtaggaaacacttattttgtcaaagagaaaaatgcatgagtttaactaaaatacagccccccgaacatggtatgatattcaaaaaaagggggctttttttctgaaaacattgagaagcgcggcagtcatttgcctcatagctatgctgtctgcatgcggacattcaaaacagatggaaatcaaagcggcggacatatcagatcttgaaaaaaacagaatggatgtcgcagcttcacaggcattcactgccgaagccgtcaatatcggtgaaggtatttcttcagctgacatgtacatcgaacattatcaaaagggaaagcttgttgagaggtttggaccggttcgtgcagattattcagaggaaaaacccgataccatacaatttgtttattttgagaatgaagagggggaaggaaagaataaacataccacccttcattttggcattgtggataaacagggaaatatagcggctgattcatcggtgaaacgcgacgatagcacaacacaggaaatgactcagaatatttcatcgccggaaccgattactttcgagaagcctgctttgatcggcagcagtattagagggactgacgagacaatgcacacctctgaacataaaaaagagctcattaagcatcaagatgcgttactgtattatgtggaattgcatcattagagtgggcggcttcaagccgtctgttttacaaagcggtatgcttgcttttttgaatggtgcatgatacattttaaatcgtaacaatttcgatttaaagggaggctatgtgacttggctaaaaaatcaaaagtggcaaaagagttaaaacgccaacagcttgttgagcaatacgctggtattagacgcgagttgaaggaaaaaggagattacgaggcactcagcaagctgccaagagattcagcaccgggaaggcttcacaaccgctgcatggtaacggggcgcccgagagcatatatgaggaagtttaaaatgtccagaatcgctttcagggagctggcccataaaggccagattcccggtgtgaaaaaagcaagctggtaagaaaaaaatccggccgattacagcgcgccggagtttttttcgtttttcttgaaagagatgacgtaggaaaggtgctggatgatcatgatgataaacacaataataatagggaaaaacggaatacgcgattgaaatagcggataaaaaatgagaagaaccgctgcggcaggcagcgagaagtagacagcgatatatgacgcgcgacatgcttttgccgtcatcatctgctctctttcatcctgctcttcaaactcatcaggcagaagaagctgctttctggcagggcggctttttttctgtaagtacaaataaaccgcagacgccgcaacaaacagaataaagggggtgaggtttaattcaaataccatcccgccgctctttgtgccgaaaaaagatgctatgccttctgaggcttcaaagtatgcaatcagcgtccagcatgcaaggccaaataacacaaggtgaaaagctgcttttgttttcatgctcatcttagttttcctcctctaaccaaaagacatcctccattttcatggagaaggctttgcagattttcagtgctaacagcagtgagggaacataatcgcctttttcgatagcagccacagtctgtcttgtgacgccgaccgtttctccgagtttttcctgagaatagccgaagcgtgccctcagctcttttactttatttttcatcatgacgtctgtccccttcacaatctcgattgattatattgtatagtatacttaacattatgtaaatggaacttaacaactttacaaaaagataactttttttcgacaaaatttttatattcccttgacgaaaaataaataaacatgtaatataaaaaaagtcagagcggtactgttgctgacaaccacaaatgcgggtgtagtttagtggtaaaacctcagccttccaagctgatgtcgtgagttcgattctcatcacccgctccatacatacgttattaacgcagtgtttcgtttctcagataaacgaagtattgcgtttttttatgtaaaaaagaacacggtattcgtgttcttttacgtaagccaatgtactgtatgggtgccgccgtgaatttgttcaaacattttcgttaatgatgataagaggttaacagagctgcttttctcaatcgatggcgggaaaaaaatgatttgcagcatattcttagtctcgtttgaaacgggatagtggttgacgctgtttttgaaatcgccaaaaataccgttttcatcagagaaaagcaatatgttttctttttctcccaatgagatccggaccggctcatgaagctttccggcatcataaatcataataggcagagaatattttaatgcgaaaaaatcgattgtgtcatgggccgagtctttactttccatgaattgttccttggatatcgggaccagcatgtcctccattggggttgtttctccctcaaatgaagggttaagctgtttaaagagttcctgccattccttgacgaaggattcatcggatataccgccgtccgcatagtcgaaaaacaaggattcttgaaacaggcggagtctgcctttcagcatttgcggtgaggagccgacttcgatattctcataaatgacagcagctgcatgtaagccggccgcacgttcagtaataacagaatcaagtttgatattcactagcattcactccagttacgtgatatcaacctattataaacgctgtatcgttttatcacaaagaaaggaggctgtgcaaaacatgaacgtttatcagctcaaagaagaattaattgaatacgcgaaaagcattggcgtggacaagattggttttacgaccgctgatacttttgacagtttaaaagaccgtttgattcttcaagaatcactcggctatctctccggctttgaagagccggatatcgaaaaaagggtgacgccgaagcttcttttgccgaaagcgaaatctatagttgcaattgctctcgcatatccttccagaatgaaggatgcgccgagaagcacgagaactgagcgcaggggcattttttgcagagcttcctggggaaaagactatcatgatgtgttgagggaaaagcttgatctgctggaggattttctaaaaagcaagcatgaggatatcagaacgaagtcaatggttgatacaggtgaattgtctgatcgcgccgttgcggaacgtgccggaattggattcagtgcgaaaaactgtatgatcacaacacccgagtatggctcttatgtgtatttggcggaaatgatcacaaatatcccttttgagcctgatgtgccgattgaagatatgtgcgggtcctgcacgaaatgcttggatgcctgtccgacgggagccctggttaatcccgggcagcttaatgcgcagcgctgcatctcttttctaacccagacaaaaggatttttacctgatgaattccggacaaaaatcggaaaccgcctgtacgggtgcgatacgtgccaaacggtatgccctctcaataaagggaaggattttcatcttcatccggaaatggagcctgatcctgagattgccaaaccgttattgaagccgcttttgaccatcagcaatcgggaatttaaggagaaattcgggcatgtctcaggttcttggcgcgggaaaaaaccgattcagcgaaacgccattctcgcgctagcgcattttaaggatgcttccgcactgcctgaattggcggaactgatgcataaggatccgcgtcctgtcatcagggggacagccgcatgggcaatcggaaaaatcggagaccccgcatacgcggaagagcttgaaaaagcgctggaaaaagagaaggatggagaggcaaagctggaaattgaaaaaggaattgagttgctaaaagcttcaggcatgactaaacaaggcttgtcctgacatacgtatagagcagaaggaaaaaacacttgagatcatccaagtgttttttctctataaaaaagtatggcgggtggggtgagcttgaagcacattttagaacaattagcggaggagcggctgggctttctggttaacgggcatgctatgagacaggagtctcaagtcggagaccttaaagtcatggagcgtaagaaaaagcttctggaaaaacgtaaagttgacatcataaaagcgaaagcaaaggccgtgattaatcatgtgcgggttgaggatgacggaacgacctgcctttcgtataccatccattacgaatacgtgtgtaaggaacaagatgacagcttgtatatagaagagcacatagaggagcgaatggctttcctgtatgatcacattttgattagtgatcaggaaattgcgaaaaagccggctggatttcatgaagggaccagtattattgactattctgaagctgaagaggaaagagaagcgtttggcagggcttttcaatacgatcgtctcggcgctgtccaatatgccgagaaattttggaacaagcgcaatcctgcttataaaaatttcagcgataactgtacaaattttatttctcagtgtcttcatgcaggaggcgcgccgatgcgcggtcatccgaacaggggatcaggctggtggatgaaacaaagctcatggagctacagctggacggtggctcactctatgaaaatgtatttgtcgaattcaaaggccggactgcgtgcggtgcgggtgaaatcagcggaagaactgatgccgggcgatgtgatttgctatgacttcgaaggagacggccggtttaatcatacaacgattgtcgtggcaaaggacaaaggcaatatgccgcttgtcaacgcccagacctatgacagccggatgaggtattggtcatatgaggattctacggcatacacgccgtcaatacgatatgccttttttcatatcgttgatgatacgacaaaagagtaattaatgttataatgatgggcggataagaaaaacagaggtgaacattgtggcattacatgtcgttttatatcaaccagaaattcccgctaacacagggaatattgcacgtacttgtgcagcaaccaatacaacgctacacctgattcgtccgctcggcttttcaacggatgataaaatgctgaagcgtgccggactcgattattgggagtttgttaacgttgtgtatcatgattcgttagaagaattgtttgaggcatataaaaaaggcaagtttttctttattacaaaatttggccagcagcctcatacatcatttgattacactgatcttgacgaggattatttcttcgtgttcggaagagaaacaagcggtttgccaaaagatttaattcaaaataatatggaccgctgcctgcgtcttccgatgacagagcacgtcagatcgttaaatctgtccaatactgccgcgattcttgtttatgaagcgctgcgccagcaaaattaccgtgatttaaaatagtgaaaaaacccgctcatcgatgatgggcgggtttttttgcggatgttgaaatgctttgtttcgtttttgggcttaacaacgtaacagtgttatgttacaatgtacccatcaaaggagctggacttatggaagaacaattaatctctaaaaaagaattacttgaaagaacatcgatttcatacggtcagctgtatcgatggaagcggaaaaacttaatacctgaggaatggtttattcgtaaatccacatttacagggcaagagacgttttttccgagagaggagattttaaaacgtatatcaatgattcaaaagatgaaagaaaatttgtctttggatgaaatgagggaaatgctgtcgccgaaaatgaaggatgtcagcatgaccgctgatgaattgcttcataaaggtttggtttcaaggcctgctcttgaagcctattcagaagacggaggaagtccggttttttcatccagcgatttgctttcgctgtttgtgcttgagggcctgctgcagtctggaaatgtcagccttgcagaagcaaaaatggctgcagaggtattaaagaagcatgatactgaagagattgaaaaacagacggagctgattgtgctccgcaagctcggtgtcacaacttgttttatagcggctgcggcggacagcattttgtttgaatcatccgtaaaggttgtggaacgggtagatttattaaaagcttcagaggaattaaaaacaacatttatgcaggagggccatcaatggatgtagtggaaaagctggtgataaacgggtcaggaagttcaaagggaggaacatttcaatctgttgagattaatggcagcgggacagtggccggggacgtggagtgtgacactttttcttttaatggaaacggaaaagccgacggcagcgtcaaagcgaaagcggtaaccatcagcggttcaggaaagatacatggagacgttgaagcagaatctatccggatgaatggcactggttttattcaaggagaggtatctgcaaaacaattgaaaatcgctggatcatcaacatttggcggcactgtcaaggctgatggcattgacattagcggaaaagctgtcatggaagcagattgtgaaacagaaacctttcaatcagaagggaaatgcaaaatcagcgggcttttaaatgcagaccaggtgatcattaagctttctgcaggggaaagctatgtgcgggagatcggctgccgccatcttcaagtgacctgcagaaaaggaatgctgacattgctcagattgatgccgcagcctgttctaacagcagagctgatcgaaggtgacgtgattgaattgacaaatacaaaggcgaaaaccgtgcgcggaaataaagtggtcatcggcccggattgccagattgaaaccgtcgaatacagtggggactatacctgtgatccaagcgcgtcggttgaaacatccacaaagttgtaaggaggatcgtaatggagacaacaaaactgggaaatttaaaattatatggcgctgggcatgccgcaggaggcgcgtatcataatgtcagcatcaaaggagaaggtgtagttggagaagggctgtctgctgtaggctgccgcatatacggaacgggcctttttctcggaaaagcagagactgagcggctgcgtgtgctcggagaaagtgaatgtaaaggcgatctgacagccggcaaaatcaatatatatgggacaatgaaagtcagcggctcacttcaatttgatcgattcaatctgaaaggccagactgaaattggcgggaatatgactggagaatcctgcgatgtgaaagggaagcttagcgtaataggtgattgtgaaacagaaatgttccatgtcacaggctgtgttgatgtatcggggttattaaattcgggtgagatcaagctgagattgagccatgatataagccatgtgcaggaaatcggcggaacaacaattacagtgaaaagacgcgcgagtttttttagccggaagaaagggaagctgatcgccgatgtcatagaaggagatcgggtttatttggagaataccgaagcggcagttgtcaggggaaaagaagtgatcatcgggccgggatgcagcatcggaacgattgagtacgaaaacaaatgtgagtgcgatccgcattcacagatcaaagaaaaaacaaaactgtaaaacattgttctgttatacaaaaaggtgctctttcaggagcacccttttttattcttttccaggcttgctatcgtatcctgcggtaaaaattgatactaaaaaagtgacaatgacacccatcatgatgattgttttcaccgtctctccccctcttcaatttttccgtgctgtccgagtctggatgattctgtatttttctttattatgaacggtcgcagtctgccttgtcaacgatgtataagtatctttatttttaagaaaccaaagcatgtatcacgagatggcggcatagattgtatcaaagtaccttatttgcatagtgtatcaaacatgatagaggaggtccttatggatatattaaagaaaattgaacagtacagagaggaagagcagcggctgaaatgggaaggaactttcgccgattatttggagattattaaagaaaatccgatggtcgcgcaatctgctcattctcgagtttttaatatgataaaagacagcgggatagaggagattgacggacgcaagaagtacagtttttttgaccgcgagctgttcgggcttgaagaatctctggagcgtcttgtggaagagtattttcatccggctgccaaacgtctagatgtcagaaagcggattctattgctgatggggcctgtgagcggcggtaaatccacgctggtcacgatgcttaaaaaaggtctcgaagcgtacacgctgacagataatggcgctgtatatgcgattaaaggctgcccgatgcacgaggaccctctacatttaatcccccatcatttacgcgatgacttttacagggaatacggcattagaatagaaggaagtctttctcctttaaatgtcatgaggctggaggaagagtacggaggaagaattgaggatgtgaaggtggagcgcatcttcttttcagaagataagcgtacgggaattggaacattcagtccctctgatccgaaatctcaggatattgccgatttgacggggagtattgatttctcaacaatcgccgagtacggttcagaatcggatccgcgcgcttaccggtttgacggagagctgaataaagcgaaccgcgggatgatggagtttcaggagatgctgaaatgtgatgagaaatttctctggcatttgctttccttgacacaggaagggaattttaaagctgggcggtttgcgttaatttctgctgatgagctgatcgtggctcacacgaatgaaacggagtatcgctcatttatttctaataaaaagaatgaagccctgcactcaagaatcattgtgatgccggttccttataatttaaaagtgtctgaggaagagagaatttatgaaaaaatgatcgcagaaagcgatgtggcggatgttcatattgccccgcatacgttgaaggtcgccgcgatgttctcaatccttacccggttaaaagagccgaagcggtcggatattgatctggtcaagaaaatgagactgtatgatggagaaagtgtggaaggatataattctgtcgacgttgaggatatgaaaaaagaatataatgatgaaggtatgagcggcattgatccgcggtacgtgatcaaccggatttcttcaacgattatcagaaaaaatatggaatcgattaattctctcgatgtccttcgttccttaaaagaaggtcttgatcagcacccatcaatttcaagcgaggacagagagcggtatttgaattttatttctgccgctcgcaaggaatatgacgacattgcgaaaaaggaagttcaaaaagcgtttgtgtattcgtatgaagaatcagcaaaaacacttatggacaattacctcgataacgtagaggcttattgcaataaaaataagcttcgtgatcctttgacaggagaggaaatgaaccctgacgaaaagctgatgagatccatcgaagagcagatcggcatttcggaaaacgccaaaaaagcgttccgcgaagaaattttaatccgcatctcggcctatgcgagaaaaggcaagcggtttgattacaattcccatgaaagactgcgtgaagctattcagaaaaagctgtttgctgatctgaaggatgtcgttaaaattacgacctcaacaaaaacgccggatgagcagcagctgaaaaaggtaaatgaagtcgtggcccgtttaattgatgagcacggctacaactcgacgagcgccaatgagctgctgaaatatgtcggcagcctgctgaaccgataagcaacgtgacccgtccgaatagggcgggttattttgtcccattttctaaatagtttgtcaattaaacgtgcatatgtgcatatgatgaatataaatcttttcaaaagacttgtttcataatctggcacaagccggaatacgtatgtatcacgaccacaaatggttaaggaggggaattcatgtcccaaaatgacagcggccattttttgatttctgaggaaaactggtccctccatcgcaaaggcttcgatgaccagcagcgccaccagaaaaaagtgcaggaagcgatcaaaaacaatcttccggacctcgtaactgaggaaagcattattatgtctaatggaaaagatgtagtgaagatcccaatccgttcacttgatgagtataaaatccgttataactatgataaaaataaacatgtagggcaaggagacggcgagagccaggttggagatgttgtggcccgggatggatcagacaaaaaacaagggcctggaaaagggcagggtgccggtgatcaggcaggcgaggattattatgaagcggaagtttcattaatggatttagaagaagcgctttttaaagaattagagcttccgaatctccagcaaaaagagcgggacaatatcattcatacagatatcgagtttaatgatatccgtaaaacagggttaaccggtaatattgataagaaaagaacgatgatgtcagcctttaaacgaaacgcaatgtcaggaaaaccgtcgttctacccaatttatccggaggacctgaaatataagacgtggaatgacatcacaaagcccgaatcaaaagccgtcgttttagccatgatggatacaagcggcagtatgggggtttgggaaaaatacatggccagaagcttctttttctggatgacccgttttttgcggacaaaatacgagactgtggaaattgaatttattgcccatcatacagaagcaagagtggtctcggaggaggattttttctcaaagggagaaagcggcggaacaatttgttcttccgtatatcggaagtcgcttgagcttattgatgaaaagtataatcccgcccgctataacatctacccgtttcatttttctgacggtgacaacctgacatctgataacgcgcgctgtgtgaaactggtcaatgatattatgaagaaggccaatctattctgttacggcgaggtcaatcagtacaacaggcattcaacgttaatgtctgcatataaaaatgtaaaagatgagaaatttaagtactatattttaaaacagaaatctgatgtttttcaggctctaaagaactttttcagaaatgaagagtctggtgtaagccatcaattttcgtaatgaaaagcccatttcagggcttttttttatttaataaaagcaagaaaacgcttgcgaaaaaaatacgggagaaaaagaaatttttcctttgacaaatcttctttcatttattaatattttatcttgtgaactattattgaggaatgaggtgaaaaggagttgactgaatcagaacgtgctttgctcacttttgaacagctcttcgatacgtctcgggcgatatataaaaaacagaagaagatattggagattgtgcttgagccttttgatattacagtccttcaatatttgctgatgtttaaaattcatcaaagcggaagcaccccgctaagcaagctggcaatgtcgcttgatcttaagcctgcttctgtgacgcggatgacagatattctgtataagcgccaattgatgaatcgatatgacagtccggatgaccgccgtatcgtcatgattcagttaaccgaagagggggaagaactgatagaaaaagccgctgtgcaatatgcaaaaatgggtgccggcttgtaccaaaagcttgatacctcccagctgcagtatttgcgcaaactagccggaagcttaacgaagcttgctgaaggctgttcagaaaaaagcggtaattaaaaacttctcacatattttcaccagctttccgcaaaatgatagaggatgaaacgaaaggagaaaacaaaatgaacagaggacgtttaattctgaccaacattatcggtttgattgttgttcttgcaattatagctggaggtgcttactactattatcaaagcacaaactacgtaaaaacagatgaagcaaaagtagcgggcgatatggctgctattactgctccagcagcaggtaaagtatctgactgggatctggacgaaggaaaaacagtgaaaaaaggcgacacagttgcaaaaatcaaaggcgaacaaactgttgacgtaaaatccattatggatggaacaattgtgaaaaacgaagtgaaaaacggacaaaccgtacaagctggtacaacaattgcacaaacgattgacatggacaacctatacatcacagcaaatattaaagaaacagatattgcggatattgaagtaggaaatagtgtagacgtagtagttgacggagatcctgatactacatttgacggtactgtagaagaaattggttatgcgactaactcaacttttgatatgcttccttctacaaattcaagcggaaactacacaaaagtaacacaaaaaattcctgtgaaaatttcaatcaaaaacccatctgataaggtgcttcctggaatgaatgcatctgttaaaatttctgagtaaaacagatcagtcatcaaaccatgaaaggaggttgtcttagatggctacaggcaaagaaaaaaatgcaaaaaaccctatgtcattgctgattgtgctaatggcgggtttatttttggcaattctaaaccaaacactgcttaatgttgcaatgccgcacttaatgactgaatttggcgtaagtgcaacgacgattcagtggctgacaacaggttacatgcttgttaacggtgtattgattccgttatctgctttcctgattacacgatttggccagcggagtctctttctcgtcgcgatgttttgttttacgctcggtacgttagtctgcggtatcgcacctaacttctctacaatgctgatcggccgtttgattcaggccgtgggcggaggtatcttgcagccgctcgttatgacaaccattctgttaattttcccgcctgaaagcagggggaaaggaatggggattttcgggctagcgatgatgtttgctccagcggtcggcccgactctttccgggtggattattgagcattatacatggcgcattatgttttacggacttgtgccgatcggcgcaattgttatcattgtggctttcttcatctttaaaaatatggtggagccgcaaaaaatcaaactcgatactcttggcgcaatcctctcgattgtcggattcgcctccttattatacggagtcagtgaagccgggtctgacggctggaccgacccgattgtattgtctacagttattatcggagccattgcaattgttgcttttgtggttcagcaattgcgtcatgatgatccgatgcttgatttcagagtgtttaaatatgacattttctcactctcgagtgtcattaatatcattattacagtggcactttacactggtatgttccttttaccgatctatctgcaaaacctggtcggctttacggcgcttcaatccggtctgcttctgcttccgggtgcgatcgttatgctgattatgtcaccgatctcaggtattttgttcgataaattcggaccgagaccgcttgcgattatcgggcttctcgtgacagtggtaacaacatatcaatacacgcaattgacaattgatacaccatatacacacatcatgctgatctattcaattcgtgcatttggtatgtctctcttaatgatgccagtcatgacagccgggatgaaccagcttcctgcccgtctgaacagccacggaacggcgatgagcaacacgcttcgccaaatcagcggatcaatcggaacaagtttaattacgacgatttatacaaaccggacgacattccattattcacaaattgcagataaaacaagcacggcggacccgaacttcctccatgcgttccaaaatgcagtttcgaatttaatggtgaatatgaatgtgtcttatgatacggcgaaaacatatgtgtactcacatatttataaacacgcgtcactcgattccaatgtcatggggataaatgatgcctttatgtgggcaaccttattctgtgtagcaggtttgattttaagtatcttcctgcgtgacgtcagaaaagataaattgcgtaaaaagaaaaaagaggagctttcattacttcctgctccaaaagaagctaaggaatcttaatctgtacagggaggtttcctgaatgaaaatttatgtagtgtatgatagtgaaggcgaacatactaaagtgcttgcagaagcgattgctgaaggcgcgagagaaaacgacgcggctgaagtgttcatcgaccatgtagatcaggctgatatccgcaagcttaaagatatggatgcgattatttggggatgcccagggcatttcggaacaatcagctccggtcttaaaacttggatcgacagacttggctacttgtgggctgaaggcgagctgatcaacaaagtcggtgctgtcttctgcacaacggcaacaacacacggcggcttggaaatgacaatgcacaatttaatcacgccgatgttccaccaaggcatgattgttgtcggactgcctggcaacgtgcctgaaaacgcactttatggctcttattacggagcaggtgtcacttgtccggtagacagtgatgagttaatgtctgaggaaggtattcagcttggacgcgcgttgggaagacgtgtcagccaagtcacaggaaacctaacagcaggacagtaaggagaggttgaaatggccattattatagcaataattgctgctgtcattgtcattgcggcccttattacatttaacgtccgcaacgcctcacctggacctgagaagcaagaagcaacggatagaatcgcacctccagaagaggaaaaaaacgaagcgcattaccctgctgaagcaagggctgccgagcatacgccatccgttgtcaaaaacgattctccaaaagagaagcgtgacacaatgggtgatgatatttacaggcaggcgctgcaaaagtttaagcattctgatgaagttcatgcagaagaagaggtcactgaggaaagtgacaaaatgcaggaccgcagctatcgtgatgcgctgctctctatgaaaaataagaaaaagtaatgaaaaaggcaaatccgtttactcatgcgggtttgccttttttgctgtttccatcaattatgtttttatcaaataaatccatggaatatgttgtattccaccttgatctagtgtactatgttactcatacaccgaggattttttccgggaggtaaagacatgaattcttttttaggtttattaaagaaagatatcaagctttcaagaatgtggctgctagtatggatatgcggaatcattttcttattgggaacaggccatattatagcttctcgtacgaaagaacctctagtcatttttggtttttttgttgcagttgctttttttctgcttttcttatctcctgtttttgtgttttatcaccttcgcaaggaagggaaatcacagctttggctgtacaatccaaatggcggcttatggctgttttcttctaaattggcagcatctttgctctatcaatttgtgattcagttggcattaacagcctatggcatatggatgtatcatatgctctctgtaaaaaatctgctggagcatcaagttgatataacgagtacagtggctttgctgaatatgtatgggcttatttcttcgttagatatgtcagtaacagtcattgtgttttggactgtttttcactctctcagaaattggcgcggaatgcggtgggctgcgatggttctgttggttgcagtgtggttattcttcgatgaatacatcataagccctttggttgaatctcaaaagcatttctggcctgtaacagtctattgcaattttgatttccacttccacaatctttggagattggaactaaaacctatccatctgtctgtgctagggtttcctattgctatagtcatcacgttcttgctgctcatcatggcttcaaaactgcttgatcgtaaagtagaggtgtaaatatggacaatcaattccaatcctcgaaaccgatttatctgcagatcgctgatcagatcttttataggctggtcaggaaggagttgctcccaggagacaagcttccttcagtaagagaaatggcgattcaaactaaggtaaatcccaatacaattcaaagaacgtacagtgagatggaaaggctgggtattgtggagacaagaagaggtcaagggacgtttattgcggaaaaagcagaaatcgtagacgagctgaaagacaagctgacacgagaggtgctggaaggctttgtcaagcaaatgaaagagctggggctaacgaaagaggaaatgttagaagggattaaaacattcacagagggaggctaaaatggaaatcaagctagaacatgtatcaaaaaaatacggccgccatacggccgtcaatgatgtgtcaatcaccctatcatccggacggatttatggcctgatcggaccgaacggcagcggcaagtcaacgaccctgaaaatgatggctggccttctgtttccgacttcaggatttgtgaaagttgatgaagagcaggttacgagagaaatggtgcgtcaaacggcttatcttactgagcttgatatgttttatccgcatttcactgttaaagatatggtgaatttttatcagtcgcagtttcctgattttcaaacagaacaggcttataagctattgaatgagatgcagctgaatccggaaaaaaagatcaaaaagctatcaaaaggaaatcggggccggctgaaaatcgttcttgctttagcgagacgggcagacgtcatcttgcttgatgaacctttttccgggcttgatccgatggtcagggattccatcgtaaacagccttgtgtcgtacattgattttgagcagcagattgtcgtgatcgcgacacatgaaattgatgaaattgagactttgttagatgaagtaattatcctcgccaatggggaaaaagttgcgcagcgtgaagtagaagatattcgtgaacaggaaggcatgtctgttttgcaatggtttaaatcaaaaatggaagtttgctagaaagaggaggaatatgatgaaaacagtgttggaattgaaaaatgtgactaaaaacattagaggccgaacgatcattgatgatctcagttttacgattcgtgaaggcgaggtattcggttttttgggaccaaacggagcggggaaaacgacaaccatccggatgatggtggggttaatgaagctgtcgaaaggtgatgtcctcatttgcggccaatcaattacgaaagaatatgccaaggcgattaagcatatcggagcgatcgttgagaatcccgagctgtataaatttttgagcggatataaaaatctccagcaatacgcaaggatggtcaagggtgtcacgaaggaaaaaattgatgaagttgttgaactggtcggtttaacagacagaatccacgacaaggtgaaaacatattctctggggatgagacagcgtcttggcttggcacaatgccttctgcacgatccgaaagtgctgattttggatgaaccgacaaacggccttgatccggcggggatcagagaaatcagagatcatttaaagaagctaacccgagaaagaggaatggctgtcatcgtttcaagccacctgctgtcagaaatggaactgatgtgtgatcgaattgcgattctgcaaaaaggaaagctgatcgatattcaaaatgtaaaagatgaaaacattgatgagaacgatacatatttcttccaggttgagcagccgaatgaagccgctgctgttttaaatcagtacgatttgctgagtaagacaaatggtgtagaaatcaaactggctaaagacgaagtccctgcggttattgaattgctggtgatgcagcaaatccgtatttatgaggtcaaggtcataacaaaatcattagaggaccgtttcttagaaatgacaggtgaaacaaaagaggaggttcagcatgcttaatttgatttataatgagtggctcaaaattttcagccgtgccggaacatgggtgatgatcggaattctggggctgacaatggttggatttgcatttttggcgaatcatttttctgctggtgaatcaaattcccattggaaacaagaacttcaagcacaaaacgccgaattaaagaaagaaatcaaagaagatccttcactgaaagatgggtataaagaaacaatcacactcaacgactatcgcatcgagcataatatccctagtgacacgggctatacggtatggtcttatgtaacggattcagcaaactttaccatccttaccggtctgtttactattatcatcgcggccggaattgtcgcgaacgaatttaattggggaacgattaagctattaatgattcggccgctcagccgttttcaaattttgatgtccaaatatattacagttctcctgtttgggctcctgttgctgttgattttatttatcggttctactttattagggttgatcttcttcgggacgggtggtgaaaccgccgcgaatattcatttaatctataaggatggccatgtcattgagcaaaacatgatggggcatttggccacaacgtatctttctgaatccgtctcggctttaatggtggcgacgatggcatttatgctgtctgcggtattcagaaacagctctcttgcggttggtttttccatcttcttgttggttgccggtacgactgcaactgcatttattgcagcgaaatttgactgggcaaagtatatattgtttgctaatgtcgacttgactcagtatgtggatggcacaccgttaataaaagggatgactatgacgttttctatcgtcatgctggcgatctactttatcatcttcttgttgcttgctttcggaatcttcatgaagcgggatattgcaaactaataaagaaagctgttttgcataagcaaaacagcttttttgtcaaaataaaaactgcaggtttgcacctgcagtttttcatatcaatttatgcttacgcttctttagtaacgttagcagcttgtggtccgcggtttccttcaacgatttcaaaagaaacagcttggccttcttctaaagttttgaagccttcgccttgaatagcagagaaatgaacgaatacatcgtcttgaccttctacttcgatgaatccgaaacctttttcagagttgaaccattttactttaccttctaacatgaaatttcctcctaaagcgatcataacgcttaaattcactattcttgctcttaacaaactttcaagacgaaaactcttacaaaactttcttcttaaagatagttcgaacaaaaataattacctttactctaccagtaatcttcagaaaaaacaactgcttattgaaacttttttcggaaaataccatatttatttttcaatttgatatttatttgcggtaattcatctgctttctcgatatgtgatcatacgtttgccttagtattccttcattttgggaagataagtaataggaattgacaaccttattggatatgagtaaggtaaaagttaatcaatattacaaatgacaacgtttatcaactaagagagcgtatgatttttatgtctgatattgcttgcatgctctaatacatagataggagtatggtcacaatgaaaaagtggcttatatgcagtttcgtccttgttcttctcgtttcatttactgcatgttcaccgtctgcagaacatgaatcgataaaaatcgggattgctgagtctgacgggacaatatggaactatattgctcaaaaggctgaagaggcagggctggatattcagctgatccctttttctgattatgcggagtctgatatcgcacttgctaacaaagaaattgatgccaacgcctttcaaaccatttcatattttcagtcgttcacccaaaaatacaaacttaatttgacgccgctcgggacgacatacataacgcctatgggcatttattcaaaacgatatgaccgaatccaagatataccgcgaggagctgtcgtttctgttccggatagagcgttcgattttggcagggcgcttacggtgctccaggaagcgggtttgctaacgctgaaaaacggatttaacggaacaggttcagttgatatgattaaagataatccgagacacctgaaattaaaagctgtccggcaacaggatgcagtgagcggtgccgacgtgtttgtcatgaaaccatcagaagcaaaaaaagcgggcctgaacccgaaaaagcatacgctaaagagcggcggactcatgtctgaggaagagatgaatttgattgttgtcagagcggaggatcaagaccgggaagcgctgcaaaccattcttgagctttatcaagctgatgatacagcggcatttatagaaaaagaatatcagggagatcttgtcccggcttttctgcctttgaaacgtctttcagattggaagaatgaattcgaacattgaattcattcttttttttctgaaaaacacactctgttccgtcccgtttctttcgctttgtaaagcatttgatcggcaagaatgggcaaggatcctggctgttccgtattattggggtaatgagcggctcctagtgatatcgtaactgaaagctcttcgccgtttgttaatacaatcggtgcatcgcttacagcgctcctgatccgttcagcgattcgggctgctttatcaagagaacagttcggcaggagaacggcaaattcttcaccgccgatccgagcggcaggatctgtatttcggatgctctgcttcagtcgtaaccccagctctttgagcacctgatctccttcatgatggccatattggtcattgatggtcttaaaatgatcgatatccatataaatcagtgcaaattgaaaatgcggggtatcggccgcctgctgatacagagcttttgtggtttcttcaaactttcttcggttatacacgcctgttaaaaagtcaaagtgcgcctgaaacttatattgtttaaaaagaagatgtgcatttgtttcatgatcaataatatataaactgagcatgccgcccgctattgatatgatccaaaaatacaaatgaagttcgtatgaatgtaaatctataagaaaataaaaggaaaaggagatcaagctatttgtgattattaaaagatagaaagcatgttttagttgaactttttttcttctagaaacaatgagtgacggaatggcagcgatacaaatgataataaccgagtatagtgcagatgtgttcatcgtaatcagcaagcggcctgcagtgatcatggccagggccgttgccgttgatacccagcctccataaagagcggcaatcataatagggatatttcgaagatcaataattgaatgctgataggtaaatccaaaaaccatcagaataaccccgagcaaaccgcaggccagtcctttaacagcttgaaaggatatgctgtcttttttatgtactagcctttctttaaacaggtgggtgaagagataattaaatgtgattaaaatggtcaaatttacaaacagttctttcagcaaatattatcacccttatataaggtactaaagatggaagggaaagaaaagaacaaaaaaggcattatataaggtttttttacttgaattgataagttaaaataattcgcacttgacccatcggaattagtgtaatatagtaaatgagaaaatttgaagggagagttacctgctttggagactttactggttgtattacatgtatttattttatttttacttatcttagggctctttgttatgcagaaaaaacatgtttccttctctaaacgtgtatttactgcgctggggctggggattgtattcggatttgctcttcagctgatttacggcccgacttcaaatatagtcattcaaacagccgactggtttaatattgccgggggcggatatgtcaaattgcttcaaatggttgtcatgccgctcgtctttatttcgattctcggcgcatttacaaagctgaagctgacaaaaaatcttgggaaaatcagcggtttgattatcgggattttagtagcaacaacagctgttgctgcagctgtcggtatcgcgtccgcactttcatttgatctgcaggcgattcaggttgaccaaggaagtacagagctttcacggggacaggagcttcagcagaaatcagaggatatgacagcgaaaacgctgccgcagcagattgttgaactgctgcctggaaacccgtttttagatttcacgggagctagaccgacttcaacgatcgctgtcgttatttttgccgctttccttggagtggcattcctcggcgtaaaacacaaacagccggaacaggcagaaacatttaaaaaactggttgatgccgtttatgccattgttatgcgtgttgtcacactcattttgagactgacgccttatggggtgctggccatcatgacaaaaacaattgcaacgagtgatcttgacagcattctaaaactgggcatgttcgtgattgcttcatatgccgcattaatcactatgtttatcattcatttgctgctgctgacgttcagcggcttgaatccggtgatttatttgaaaaaagcggtgcctgtacttgtatttgcatttacgtcaaggtctagcgcaggtgctttaccgctgaatattaaaacacagagaagcatgggtgtaccggagggaatcgcaaactttgccggttcatttggtctttcgatcggccaaaatggatgtgccggcatttatcctgcgatgctggcgatgatgattgctccgactgtcggccaaaatccatttgacccggtgtttattatcactgttatcgcagtcgttgccatcagctccttcggtgttgccggagtcggcggcggagcgacattcgcggcgcttcttgttttatcatcattaaacatgcctgtcgcgctcgcaggtttgttaatctcaattgaaccgttaatcgacatggggcgtactgctttgaatgtcagcggaagcatgacatccggtcttattacaagtaaggtcacaaaggaaattgatcaaggggcatttcatgatcaatccagagtgattgaagctgaagaagcgtaacatatgaaaacgtgtaatccccaaacaaggattacacgtttttttaacggccgggttctaagtcctccagcatttccatcatcgtgttgtcgtccatgacattcattgcgctttgttcaaaatggatgggttcagcataatgcggctgtctttttttcgcggcagtctcagtttgcctagtttgagactgtgtatgctgatgctgtggttgctgctgtcctgcgtgctggtgctgacggccattttgccgctggctttgatgctgcgaacggtcctggttatcaccgctgccgccgccaaatgcttgtttgactatgtttcctacattagaagcatcgaacgtgttattttctgaatttcgtctgttcatttgtcctgtgataaacccgctgattctgtggcggatctgaggtgataatgcagcaataagcatagttgatcctatgatcaatgctgtggggctgattcctcttcgctggttgaacaacatgatccctcctttgcaatgtattcatattttcccctcattagacaaattaaccgttatatttcccgggaaagcatttcctccagatttgcatgcataattaaagccagttagaaaaacctatacgtaaagtgataaaggaggaattcacatgcttggaaaaaaacaagtccttgcgtctgtgcttcttatccctttgcttatgactggctgcggtgtggccgaccaaggtgagggcagacgtgataataatgatgtaagaaatgtaaattatcgaaatccggccaatgacgatatgcgcaatgtaaacaaccgggataatgttgacaacaatgttactgataatgtcaataacaataacaatcgtgtaaatgacgataataacaacgaccggaaactcgaggttgctgatgaagcagctgataaagtaacagacctaaaagaagtaaaacatgccgatgtcattgttgctggaaatcaagcttacgttgcagtcgttttaactaatggaaataaaggtgcagtagaagacaatttgaagaaaaaaatagccaaaaaggtaagatctactgacaaaaacattgataatgtttacgtttcagctaaccctgattttgtagagcgtatgcaaggatatggaaagcgcattcaaaatggtgacccaatcgccggattatttgatgaatttacacaaactgtacagcgcgtattccctaacgctgaataaataaaaaaagccgcacaatttgtgcggctttttctttgcgttaatgacacactgcgaactcaggctgcatagagtaaaaataaaaaggtacaagacggaccggctcagggagggagacgtttgcgggatggcataggaaagcgtgcggcatccgctctattcctgtgcggagtccttgtgatgctggctgtaagctcagccatcgtatcaagcgcgatgtatatcctgtcttttccaggtcaggcatctggaataacaaaagaacaagtgacgaagcacatgaagaaagagtcattcaaacaggccgatatttattacacttctaaggaaaagcccctactgccattgacgaaagaaacgcttgaatatgcggtcagtattaatcagattatgattggagattcgaatcaaaagcctattgacattattttttttcctaatgaaaaacagatggaggtttactccggtttattggatgtagttggtttttattctgagcgggagcagttgattggactgttgcctgaagagaaaaagaaactgttagaaggggacgaggtagcggtttatttgtaccagagattgttgattcatgaatactcgcaccatgcgtttcatcagaaattgaaggagcttgagacggatcccgatgagtttccgttatggtttcatgaagggttaagcgagtggattgcgaactatgaattgctcatagatccgatcacgttttctgtcgtgccctttgaccgtttgcagactgatcgagactggcaggaagccagagccgaatatgacactgatgtctatttgcaaagcttttatatgatcgatgagctgacggacaaatatgggaaagacattatttcagaaatgattaaggaaacagcaagaaaaggggactttgaaaaagggtttaaatcagcaacaaaggaaagtcttgatcaatttgaaaaagatttcaagaaaaaattcgaaaaaaacagtgcggcattggatagtatctatccaatgcctttgttattagtgaagtccttgctggcccattccgccttgtgtcggaggcatttgtccttgggcaggggcgaatgaatttctcagctgttccatatcctgcgcatcaagctgaggaacctggtaatagccgtgtttgttttggtataggaaaatttcaaatgccatttcaacatactcctgaatttgcgcagacagtacgcgtcttacggccggatttgtcatttccagagaagccatcgtcagcatagaagcttgtgctttaatcgcgcaaagcatttgtcggctgatgatgctgtcatcaatatcattcatggattgaacaggttttttaggctgtgacggctgcatgccgtaaacagtctggttgtcttccttcatcatataagttgctgttttttgtgaaggttcgcttcctgttttgaagcattctgcagttatattgtattgagatgtgatgaattgatgttgacgatcaaggatgtttaataattcttgatccttacagaattgtctcagcatcataaactgatcaagcacagtaagtgttccggaaagcacctcatgcatatcaaacatttcatgtccgccatggtttttatgcggtttgccaggaatacctttgttcatttgggattgctgctgctgattgaactgatccaaaccgaattcctccttttttttcagatcagctgtattttgtgtcagtctgccgcttattatgcagaagcctgaaaggaattatatgctgtctgtcgaaatgatagacagacaaagtcattgtcattatgtgtataagggaggaaatatgatgaggcgtattctgcatattgtgttgttcacggcattaatgttcttaaatgtaatgtacacgttcgaagctgtaaaggcagctgaaccgcaacagcctatatcgattgagaaggcaatacagcaaaaagaaggacaggcgcttatcgaaggatatgcagtcggccaggctgtttccccgcagcattataagctgacaagtcctttttcaaatgattataatgtcgcgctggcagaccgtaaaaacgagacatcgcctgatcacatccttcctgtgcaaatcccctccgccttcagaagccaatttgggctgcaaaccaatccgcttcttcttgggaaaaagataacggttcaaggaaagcttgaaaattactttaacacgacaggacttaaaaacgttcagtcgatgaacgtaaccgatgacacgaaaactccgccggctgaacagccagtgaccataaatgaagcccgggaaggctgaatgaagaagtaacgataaaagggatcattacagctgatcaaaacgcaatcggaggcgggaagctgtcgacctttttgcaagatgaaaccggaggcattaacatttattcgccatcccctgaacaatttcccgaattaaaagagggtatggatgtcacggtgacagggaaaatcgcgtcttaccaggggctgaaagaaatcgttccaagctcatcaggcatcaaaatcaaccagtcaaaccaatccctccccgcccccaaacacttaacaatcaatgaacttattaacggcagcctaggtgatcagtatgaaggacgccttgtaaaactaaccgcttttgtttcctcaattccaagttctcctgccggcggcggttacaatgtaacaatgattgatgacgaccatcatgcaatgacgctccgggttatgaatgaaacaggggtgataaacgagcttgatgagggcaaatggtatgactttaccggtgtgttaagcagataccaaacctttcagctgcttccgcgaaaatcggctgacctgaagctgcttgaagagcagcccgcacctccgtctgcggagggagaatatgaagggattgttgaccgggtcgttgacggcgataccattcatctcaaatctccggtgcttggaacgacaaaaatccggtttgtaaatgtagatacacccgaaacatatcacacaccaaaaaatgacgcagatgaaaatcaattaagatttggcaaaaaagcatctgactatctaaaaacggttctgtccccaggtgataaaattactgtcaaggtcggaagtgaagccaaggacagctatggcagacttctcggacaagtcataaccgaatcaggatcaaacgtgaacttagagcttgtgaaaaatggatatgctccgacgtattttatttggccggttgacaatgaagaggattaccagcagtttcaggccgcagtagccgctgcaaaaaaagaccaaaaaggaatctggaatgaaaacgacccgctcatggaaatgccgtttgaattcagagccagagagcaagggaaaggcttgacaagatatgtaggggattcgtcgaataaaacatatgtgaagccagctgactggaagaaggtagctgtggaaaacagaattttcttcgcttcagcaagtgaagcggagagcgcgggatataaaaaaaggcaaacggcacctcaagaacatgtgccgcttagaattctcagcatgaatgatttgcatggcaaaatcgatcagcaatatgagcttgatcttgatggaaatggaactgtagacggcacgtttggacgcatggattatgccgccgcatatttaaaagaaaaaaaggctgaaaagaaaaactcgctgattgtgcacgcaggagatatgatcggcggaagctctccagtttcctctcttcttcaggatgaaccgactgtagaactgatggaggacatcggatttgatgtcggaaccgtgggaaaccacgaatttgatgaaggcacggatgaactgctgaggatcttaaatggcggtgatcatccgaaaggcacaagcggatatgatggacagaactttccccttgtatgtgccaattgtaaaatgaaatcaactggagagccctttttgccggcttatgacatcataaatgtggagggcgtacccgttgcttttatcggagttgtcacacagtcggcagctggcatggttatgcctgaaggaataaaaaatatcgagtttacagatgaagcaacagtggtgaataaggcggccaaagagctgaagaaaaaaggcgtgaaggccatcgcggttctcgcacatatgtcagctgaacaaaacggcaacgccattacgggtgagtccgctgatcttgcaaacaaaacagattctgaaattgacgtgatttttgccgcgcataatcatcaggttgttaacggtgaagtgaatggaaaactgattgttcaagcgtttgaatatggaaaagcgataggtgtcgttgatgtagagatcgataaaacgacaaaagacattgtcaaaaagtccgcggaaatcgtatatgttgatcaaagtaaaatcgaaccggatgtcagcgcgtcagacattttaaagaaatacgaaacaattgcggaaccgattatcagcgaggtagtcggcgaagccgctgttgatatggaaggggggtattcaaatgacggcgatacacctcttggaaacctgattgcggatggtatgagaactgccatgaaaacggattttgcccttatgaatggcggcggcatacgtgaagcgctgaagaagggcccaattacgtggggagatctttacaatattcagccatttggaaatgtgttaacgaagcttgagattaaaggaaaagatttaagagagattatcaatgctcaaatctcgccggtttttgggcctgactacagcatcagcgggtttacgtatacgtgggataaagaaaccggaaaagcagttgatttaaaaatggcagatggcaccgagatccagcccgatgccacatatacattgactgtcaacaactttatggcgacggcgacagggaccaaatatcagccaatcggactgctgggaaaaaatccggtgacagggcctgaggatttggaagcgacagttgagtacgtgaaaagttttgatgagccaattgcgtatacaaaagagggaagaattaagcttgctgaagccagtgatattgaagaccctgtaacagaagaccctattacggaagagcctggagatgatccggtgacggaggatccgattaaagaggatccaaggccaggtgaagatttgcctgatataaaagaaactccgggaacagcaccggttcatcagctgccgccttcagccatttcgagattcaatgaaataccaatcaacaacacaaaaaacgctgatactgctaatagcatcagcacattgccgttacgaaacgatggcggggaaagcgggtctgagcatccgcttccagatacatcagcaaactactataactttatcgtaatcggtgcggcggtgacattgtcaggaacttatctatatgtcagaagaaaaaggagcgcctccagaacgtgaaaaaagttattccactattcatcattgctgccggcctattgatcgcaggctatggaggctttaaattgatcgatacgaatatgaaaacagaacagacattaaaagaagcaaaactggcggctgaaaagccgcaggaacttttggggacgaaaaatagcacagatcaagcaaagaacaaagcatcatttaagcctgagaccggccaagcgagcggcattttggaaataccgaaaatcaatgcagagcttccgatcgtggagggcactgatgctgatgatttagaaaaaggtgtcgggcattacaaggacagctattatcctgatgaaaacggacaaattgtgctgtcggggcatcgggataccgtgtttcgccggacgggagagctggaaaaggggatcggctccgcattctcctgtcatatggagaattcacatatgaaattgtaaaaacaaaaattgtcgataaggatgacacatctattatcacgctccagcatgaaaaggaagagctgattctgacgacctgttatccgttttcatacgtcggaaatgccccgaagcgctatattatatatggaaaacgagtgacttaaaaagccgaggcagtgcctgcggcttttcttcatgaaaaatatgtgcgacaaaggtttttcatatcagcagggaaaggggcttcagcaactatgagctcgtctgttatcgggtgaaccgcttgtactttattggcgtgcagtgcctgcctgtttagcagcttgctcccgcctccgtaaagcgagtctcctgtcaacggatggccgaggctcgccagatgaacacggatttggtgtgttctgcctgtttccagctctaattcaacgagcgacagccgttctttcgcattgctggccattaccttgaaatgagtgacggctgtttgcccgcctggtgaaacccggcgtcttgtcgggtgtgatcggtctctgccgattggtgaattaattgtcccttttttcgtccgtagcttaccttcagcgatggcggtatacgtacgcttcagcgtctttttctctaactgctggtctaagatggcgtgtgccaaacgatgcttggcaaaaacgatagcgccagatgtatcctgatcaagacgatggacgtggcgcaccttacatgtttcgccatttatctgataatgataagcgatcaaattagccagtgtgccggtttgcccatcctcattcggatgcgtcgcgatgccagcgggtttattgacgatgagcatatgattgtcctcatataaaatatcaagctcgccatactccggaatgaccgaagatgcttcactttcctgaagatcaatgaacacgcggtctcccttttttacaatcatattgtttaagacggattcgtgattgacctttatctgttgatgggacatccagtcttgtatcactggtttagaagctttgagcgctgttttgagtacggaaaacagccattggccgtcctgtttttcattgatgaggatctcaagccctctgcctttttggttcatgttaaatggctccttttcgaagcggaaggctgctgtttctcataggaaacacttaccttagctttcgcgtttttttctgtgctattcttgagtaagacttaggatattcgatggcaagaaaggtgattgacgtgagaattgtgaacgcagcaactgcagaacaggagagctttatcaaggagctgtctatggagctgatccatgatgtatttcctctttatttctccgaactggacattcagcgctttaaaaagaaaggcgttctgtctttaaataaccattattaccaaggaacattaaaagaagcatttcaaattatggcttgtctgcaaatgatacatattatcctgaccaagccttcgccgcactctgatttgagtgatcaggcgatttttgaaaaaaacagcaagatgctgaatgattttgggatttattttccgtttgctttttctgactttcaaaagaagactaacaaagcctttttcggtcaaagaaggctgatataatcatgcggcaagggcttttctatttttagaaaagctctttttgtatcagagaaatcatatcataaaacctttcctctaactccctttttaaacggctcgtgtctgaacatactaatgattgaaaggggtgctgacaatgagttcagttaaagatacaatgacaacgcaggtggcaaccgtttctccgaatcaaacgattcaggaagcggcttctctaatgaaacagcataacgtcggggcgatccccgttgtagagcaaggtgttttaaaaggaatgctgactgaccgtgacattgcattaagaactacagctcagggccgtgatggccagacacccgtttcagaagtgatgtcaacagaactcgtatcaggaaaccctaatatgagtctggaagacgcgtcgcagctgatggcccagcaccaaatccgccgccttcctattgtagatcaaaacaatctagtcgggatcgttgcgcttggagacctggcagtcaatcagatgtcgaacgagtctgcgggatcagcgctgacaaacatttctcaccaaaacattcattaataagaaagagcttgcagtgtgcaggctctttcttcacataaaaccttactttttgaaagcagacttgtttcggggtatagttgagtgtatacatatgtctcaattcggactaaaggagttgtacccagtgattaaagcgttaatttttgattttgacgggcttattctagatacagaaacacacgaatatgaggttcttcaggaaatatttgaagagcacggctcagtgctgccgctatctgtctgggggaaggtcatcggaactgctgcgggattccggccttttgactatttagaagagcagatcgggaaaaagctgaaccatgaagagctcacaaaattgagaagagagcggttcgccaaacgcatggaaacagaaaaagcgagacctggtgtcgaagcgtatttgaatgcggcaaaggatttaggcttaaaagtaggccttgcctccagctctgattataaatgggtgtccggccatttgaagcaaatcggcctgtttgatgattttgaagttattcaaacggctgatgatgtggaagaggtgaagccgaatcctgaactctatttattgacggcaaagaacctcggggtatcgccagcggaatgtctcgcgtttgaggattctgtcaatggttcgattgctgcgaaacgtgcaggcatgaagtgtgtcattgtcccgaataaagtaacgggtaccttgatgtttgaagactatgatcacaggcttgaatcaatggcggagatggagctcgccctattgcttgatcatctgaactcacaaaactagaaaggagcgagtaggttgtctgagaaattagatttgacccggtttgaaaagaaaatggtgatccgcaatatcgaagagaaagacatcgacaagattatcgatcttcaaaaggactgctttccaggaatggagccttggaagcgggagcatttaatcagccatttggagcattttccagaagggcagttttgtgcagaattcgaaggtgaaattatcggttcgtgctcaagtctcctgattaactttgatgaatatgatgaccgtcatacatggcaggacattacagatgacggttatatcaccaaccataatccagacggcttgaatatgtatggaattgaagtcatggtggacccgaagtacagacgaatgaagattggccaccgtttgtacgaggcgagaaaggacttagccagacgcttaaacctgaaaagtatcatcataggcggacggattccaaactatcacaaatatgcagaggaaatgacagcgagagagtatgttgaacaggtgacacgccaccaaatttacgatccggttctttcttttcagctgatgaacggctttacccttatgcgaattaacccgaactatctcccggatgatacagcttcgatcaagtatgcgacgctgatggaatggaataatgtcgattatctaccgcagcagacaaaacgctattataaatcggcgttccctgttagaatttgtgtgatccaatacgaaatgaagaaaatttattcctttgaggaatttgcgaatcaagtagaatactatgtcgatgttgcttccgacgcaagatctgattttgcggtgttcccggaaatttttacaacccagctgatgtccttccttgaggaacggtcaccgagcttggcggtgcagagaattaccgagtatacagaagattacatcagcctgtttactgacttggctgtgaagtataacgtcaacattatcggcggatctcatttcgtcgaagaggaaggcaagatctataatatcgcttacctgttcagacgggacggaacaatcgaaaagcaatacaaactccatattacgccgaatgaacgcaaatggtgggggatcagcgcaggagaccaagttcgcgtgtttgatacggactgcgggaaaatcgcgatccagatctgttatgacattgaatttcctgagcttgcccggattgcggctgataaaggagccaaaatcatctttacgccattttgtacagaagatcgtcaaggctatctgcgtgtcagatactgttcgcaggctagagcggttgaaaatcaaatttatacggttatctctggaacggtcggaaaccttccgcaaacggaaaacatggatatccaatacgcccagtcaggcatctttgccccgtctgattttgaattcgctcgtgacggcattgtcggcgaaacaaacccgaatattgaaatggtcgtcatcggcgatgttgacctggaaattctcagaagacagcgccaaaacggtacagtgcgccagctaaaagacagacggcgtgatatttatcatattcaatataaaaaataattcccaaaaaacctgcctgaattggcgggttttttaaaacaaaagcggaattgtttaggtgctatctttaaaataaaagtaggtatagtggaggtgccttatagagtttctgtattttcgccatttcctatatcatacagaaaacggctaggcttcacattgctattgcaatggctgtccaagttgtttcgagtgcgacctttatcagtacgatgctgagcattgtcactttgcctgttttgctttggaagctgcatcctctttcttcttgagaaaggggatgttttattatttacgcggtttattgactctgacccggtctggctttatattgaaggcagggaaatcatcaccaagacatcacataaagagaaggtctgtttcaattgaattggcattatagggaacgctaatgaaatggagatgatggggatggaaaacattcagcaaaatcagggattaaagcaaaaagatgagcaatttgtgtggcatgccatgaagggagcgcatcaagcagacagcctgatagcccagaaggccgagggggcctgggtaaccgacatagacggacgccgctatttggatgcgatgtccggtttgtggtgcgtcaacattggttacggcagaaaggagcttgcggaggctgcctatgagcaactaaaggagctgccttactacccgttaacgcaaagtcacgcacccgcaatccaactggcggaaaagctgaatgaatggcttggcggcgattatgttatctttttttccaacagcggatcggaagcaaacgaaactgcttttaaaattgcccgccagtaccatctgcaaaacggcgaccacagccgttataaattcatctcaagatatcgggcataccacggcaatacattgggagcgctctcagctaccggacaggcgcagcggaaatataaatacgagcctttgagccaagggttcctgcatgcagctccgccagatatataccggaatcctgatgatgcagacacgcttgaaagcgcaaatgaaatcgaccgcatcatgacatgggaattaagcgaaacgattgctggggtcattatggagcccatcattacaggcggaggcatcctaatgccgccggacggatatatgaaaaaggtggaggacatttgccggcaccacggagcccttttgatttgcgatgaagtgatctgcgggtttggacggacaggcgagccgttcgggtttatgcactacggtgtgaagcctgatatcattacgatggcaaaaggaatcacaagcgcgtatctgccattgtcagcgactgctgtgaaacgggacattttcgaagcgtatcagggggaagctccttatgaccgtttccgccacgtaaacacgttcggcggaagcccggctgcctgtgctttggcgttgaaaaacctgcaaattatggaggacgaacagttgattcagcgatcccgcgatcttggagcaaagcttttaggtgagcttcaagctctgagagaacacccggcagtcggggatgttagaggaaaagggctgctgatcggaatcgaactcgtcaaagacaaattgactaaagagccggctgatgccgccaaagtaaaccaagtggttgcggcgtgcaaagaaaaagggctgatcatcggcaaaaacggcgatacagtcgccagctacaacaacgtcatccagcttgcgccgccattttgcctgacagaagaggacctttcctttatcgtgaaaacggtgaaagaaagctttcaaacgatataatataaaagtgatttattaaaggagcacatgatgagttttcacaaccagccgatcttaccggctattcgcaatatgaagcaatttgatgagtttttgaacagttcgttctcttacggtgttattcttgatattcatctcggccagctgaagggcgtgatcaaagaagcgcaaaagcacggaaagaacatgatggtgcacgtcgatctcattcaagggattaagcatgacgaatacggtgcggaatttatatgtcaggatatcaagcccgctgggattatttccacaagatcgaacgtgattgccaaagcgaagcagaagaaaatttatgccattcagcgcctgtttttgcttgatacaagcgcgatggagaaaagcatggagtttatcggcaagcataagcctgacttcatcgaagtgcttcccggcatcgttccgtcactcattcaggaaataaaagagaaaacagggattcccatctttgccgggggttcatccgtacggaagaggatgtagagcaggcattgaaagcgggggctgtagctgtcacaacatctaataccaaattgtggaaaaaatatgaaaactttttgacggaaagtgattgacaccgctttcatgcgctgatacaattgcactaggttaatacattgtgatggagaactcggagaccacagcagctctttacggcaaatgtttatgtacccgtaaagcggtttgttgtggtttttttattctcttcttctctatcatgctttttaatcgtgactttaggaggaatgtgctatgacagcattttggggagaagtcatcggtacgatgcttattatcatttttggtgcaggtgtttgtgcaggtgtcaatttaaagaaatcgctttcattccagtctggctggattgttgttgtatttggatggggattgggtgttgccatggcggcatacgcggttggcggcatcagcggtgcccatttgaatccggcgctaacgatagcgcttgcatttgtaggagattttccttggaaagaggttccggtttatattgcggcgcaaatgatcggagcgatcatcggtgcggtgattatttatctgcattacctcccgcactggaagtcaacggatgatcccgctgccaagctgggtgttttctcaacagggcccagcattccgcatacatttgcaaacgttttaagcgaagtgattgggacatttgtccttgtacttggaatcttggccattggggcaaatcaatttacagaaggacttaatcctttaatcgtcggtttcctcattgtagcaatcggtatttctctgggaggcaccaccggctatgctatcaatcctgcacgtgacttaggtccgcggatagcccacgcttttcttccgattccggggaagggctcatcaaactggaaatacgcatgggttccggtagtcggcccgattttaggcggatcattcggcggcgtattttacaacgctgcatttaaagggcacatcacaagcagcttctggattgtaagcgttatattggttgtggtattgttaggactctatgtttatacgaaatcacattctgctaaaacattatcaaattctaaatatatttaatcaaaggggagacatcttatggaaacgtacattttatccttagatcaggggacgacaagttcaagagcgattctgtttaataaagaaggcaaaattgtccactctgctcaaaaggaatttacacaatacttcccgaatcctggctgggttgagcataatgccaatgaaatttggggctctgtcctcgcggttatcgcctcagtcatctctgaatcaggaatcagcgcttctcaaattgccggcatcggcatcacgaaccagcgcgagacgacggttgtgtgggataaagatacaggaagtcctgtctataatgcaatcgtttggcagtccagacagacgtccggcatttgtgaggaacttcgtgaaaaaggatataatgataaattcagagaaaaaactgggcttttaatcgatccttacttctccggcacgaaggtgaagtggattttagacaatgtggaaggcgcaagagaaaaagcggaaaaaggcgagctgctgtttggaacgattgatacgtggctcatttggaaaatgtcaggcggaaaagcgcatgtgaccgattactccaatgcctcaagaacactgatgtttaatatttacgatttaaaatgggacgatgaactgctcgacattctaggcgtaccgaagtccatgctccctgaagtgaagccgtcctctcatgtgtatgcggagactgttgattatcacttcttcggaaaaaatatcccgattgctggagcggcaggcgaccagcagtccgcattgttcggccaggcatgctttgaagaaggcatggggaaaaacacttacggcacaggatgtttcatgctgatgaataccggggaaaaagcaattaagtccgaacatgggcttttgacaacaattgcttggggcattgacggaaaagtgaactatgcgttagaaggaagcatttttgtcgctggctctgccatccagtggcttagagacggattgagaatgttccaggactcttcgcttagcgaatcttatgcagagaaagtggattcaactgacggcgtatatgtcgttccggcctttgtcggactgggaacgccttactgggacagcgatgtgcgcggttcggttttcggcctgacaagagggacaacaaaagagcactttatccgtgcgacactggagtcattggcttatcagaccaaagatgtgcttgacgcaatggaagcagattcaaacatttcattaaagacgcttcgtgtagacggaggagctgtaaaaaacaatttcctaatgcagttccaaggagacctgttgaatgttcctgtggagcgcccggaaattaatgaaacgactgcacttggcgcggcttatttggcaggtatcgctgtgggattctggaaggaccgttctgaaatcgcgaaccagtggaatctggataaacggtttgaacctgaattagaagaagaaaaacgaaatgagctgtataaaggctggcaaaaagccgtgaaagcagctatggcttttaaataaagtaatactatggtataatggttacaagttaataagaacggtcctgagatgaggagagaccacagcaccaaagtgtaagcatgcactttggctgttgtggtctctttttctatttaccgtgacaacaaggaggaaacgtaatgatgaaacatcaattttcaagtcttgaaagagatcgcatgctgacagacatgacgaaaaaaacatatgacctatttattatcggaggaggaattacaggagccggaacagctcttgacgcggcatcaaggggaatgaaggtcgcactaagcgaaatgcaggactttgcggcaggaacatcaagccgatcaacgaagctggtacatggcggcttgcgctatttaaaacaatttgaagtgaaaatggtcgctgaggtaggaaaagagcgggcgattgtgtatgaaaacggcccgcatgtcactacaccggaatggatgctgcttccgtttcataaaggcggcacattcggttcatttacaacatctatcgggttaagggtttatgacttccttgcaggtgtgaaaaagtcagaacgaagaagcatgctctcagcaaaagaaacgctgcaaaaagagcctttggtgaaaaaagacggcttaaaaggcggcgggtactatgtggaataccgcactgacgatgcgagactgaccatcgaagtcatgaaggaagcggtgaaattcggggcagagcctgtgaattactccaaagtgaaggagcttctttacgaaaaaggcaaagccgtcggcgtattaattgaagatgtgctgacaaagaaagaatataaagtgtatgcgaaaaaaattgtcaatgctacaggcccttgggtcgatcagctcagagaaaaagaccattcgaaaaacggaaagcatttgcagcatacaaaaggcattcaccttgtatttgaccagtctgtctttccgctgaaacaggctgtatatttcgatacacctgatggccggatggtatttgcgattcctcgtgaaggcaaaacatacgtgggaacaacagacactgtttacaaagaggcgctggagcatccgcggatgacaacggaggatcgtgattatgtcatcaaatcaatcaattacatgttcccggaactgaatattactgcgaatgacatcgaatccagctgggcggggctgcgtccgctgattcatgaagaaggcaaagatccttctgaaatttcacggaaagacgagatttggacatctgactcaggcctgatcaccattgccggcggaaaactgactggatacagaaaaatggcggagcacatcgttgatcttgtccgtgatcgcttaaaagaagagggcgaaaaggattttggaccatgtaaaacgaaaaacatgccaatctctggcgggcacgtcggcggttcaaaaaatcttatgtccttcgttaccgcgaaaacaaaagaaggaattgcagccggtttatcagaaaaagacgcaaaacagcttgcgatcagatacggctctaacgtagatcgcgtctttgaccgggtagaagcgctgaaagatgaggccgcgaaacgcaacattccggttcatattcttgctgaggcagaatacagtatagaagaagagatgactgcaacccctgctgacttctttgtccgcagaacgggacgtttattttttgatatcaattgggtaagaacatataaagatgccgttattgattttatgagcgagcgattccaatgggatgagcaggcgaaaaacaaacatacagaaaacctcaacaagcttttacacgatgcggtcgtaccgcttgagcaataaatcataacgggctgtctgcagcccgttatttctttttacgtgccgaaagggccagatctcaggttatcaagtgacagaggcacccgcttcatataaaataatggcataagctgatacataggaggacgaatatgacttggagaaagagctatgaacgctggaaacagacagaacatttagatccggaattaaaagagcgccttattgaattagagggggatgaacaggcccttgaggactgtttctataaagaccttgaattcggtaccggcggaatgcgcggggaaatcggcgccgggacaaatcggatgaatatttacactgtgcgcaaagcatcggccgggtttgcggcatacatctcgaagcaaggtgaggaagcgaaaaaacggggcgttgtcattgcttatgattcccgccataaatctccggagttcgcgatggaagcggcaaaaacacttgcgacacaaggcattcaaacatacgtgtttgatgagcttcgcccgacgccagagctgtcattcgctgtcagacagctgaacgcttatgggggaattgtggtaacggcaagccataacccgcctgaatataacggctacaaagtatacggggatgatggcggccagctgcctccaaaggaagcggacatcgtcattgagcaggtaaacgcgattgaaaatgagctgacgatcacagtggacgaagaaaataagttaaaagaaaaaggcttaatcaaaatcatcggtgaagatattgataaagtttatacagaaaaactgacgtcgatttctgtacatcctgaattatcggaagaagtagatgtaaaggttgttttcacaccgttgcatggaactgcaaataaaccggtcagacgcggacttgaagcactcggctacaaaaatgtaacggttgtcaaagaacaggaactgccggattcaaacttctccactgttacatcgccgaacccggaagagcatgcggcattcgaatatgccattaagcttggggaggagcagaatgcagatattctcatcgcgacagatcctgatgctgaccgcctcggcatcgcggtgaaaaacgatcaaggcaaatatacagtgctgacaggaaaccaaaccggagcgctgctgcttcattaccttctttctgaaaagaaaaaacaaggcatcctgcctgataatggtgttgttctcaaaacgatcgtcacaagcgaaatcggccgtgctgtagcttcttcattcggccttgatacgattgatacgctgacaggctttaagtttatcggtgaaaagattaaggaatacgaggcatcaggccagtataccttccaattcggttatgaagagagctacggttatttaatcggggattttgcccgcgataaggacgccattcaggctgcgcttttggcagttgaagtttgcgcgttctataaaaaactgggaatgtctttgtatgaggcgctcatcaatctctttaacgagtatggtttttatcgtgaagggctgaaatccctgacgctgaaaggcaaacaaggagcagagcaaattgaagcgattcttgcttccttcagacaaaatccgccgcagaaaatggcgggcaaacaggttgtcacagcagaagattacgctgtaagcaaacggacgcttctgactgaaaacaaagaagaagctatcgacttgccaaaatcaaatgtactgaaatacttcctggaagacgggtcttggttctgtcttcgtccttctggaactgagccgaaggtgaaattttatttcgccgtaaaagggtcatctttggaagacagtgaaaagcgacttgccgtcctttctgaagatgtaatgaagacggttgatgaaattgttgagtcgacggcaaaataattcaagtatgagctgggtcattgtaaatgatccagctttttctttttctcatccaaaagtctgaaagaaaatcatcccatcagtgaagtaatgaaatacaaaaaactggtataatcttaaatacaagatcaatgccggagtgagaaacgtgagcaaaacgaggatggaaaaattaaaaacgctgaaaacgattgcggaaaccttaaatcaagggcacgatatcaaagcaacactggatgaggttttaaaagagttgctgagtctgacaaaccttcaatccggatggatttttctgatcgaagaagatgggtcttatacgttagcggccgacgcttatctgcccccggctttaagccgtaaggaaaaagtgctgatgtgcgaaggggagtgttactgcctgacgaaattcaataacggagggcttagaaaggctgcaaatatcatgaactgcaaacgcatcgaatcagcagaaaacctgcattgttttgacacagaagggattacgcatcatgcaactgtgcctttagaagacggggacagaagattcggattgttaaatgtagcggcggccggaaaaaccatgtttgatgaggaagagctgcatttactcgagtctgtcgcctttcagatcggaacggcaatccagcgtatgaggctttctgaatatcaacaaaaaaatgctcttttaatggagcgtaaccgcctcgctcaggagcttcacgattcagtcaatcaaatgctgttttccgtcagtttaactgccaaagctgcgaagacactaacaaaagatgaaaatttacagcagatgattgatttcatccaaaacctatcacaggacgcgctcgcagaaatgaaagcgttaatttggcagcttcgccccggaggattggaaaaagggttggctgaagccattaaaagctatggtgcgctcattggattgaagatcatttttacacaaaaaggctgtcctgttctgactgatgagcaggagcatatgctatggcgtgtcgtacaggaagctttaaataactgcaaaaagcatgccggaacggatacggcgtatgttagtctgactgcttctttgtgccatgcggagctggatatcatcgatcatggggcaggatttcgctatgaagcccatgccgatctgccttcacttggcatcaagggtatgaaagaacgagcggaaaaagccggagctaagttttggattgagtcagcgcttggaactggaacaaagctgtccatcaggcttccgctaacaagccgaaaaggaggggcggtatgaaaattgtcattgctgatgatcatcatgttgtcagaaagggtctgcgttttttctttgccacccaggatgatattgaagttgtcggagaagctgcaactggaatagaagctctccgtgtcatcgaagagacaaagccggatcttgtgctaatggatctgtctatgcccgagatggacggcattcaagccattaaaaaagcaatacagcaatttccggatacgaatatcattgtgctgacgagctactctgatcaggagcacgtcatccccgcgcttcaggcaggcgcgaaggcgtatcaattaaaggatacggagcccgaggaattggtgaaaacactaagacaagtgcatgctggcgaatacaagctttctacagctattatgccccatgtgctgacacatatgaaaaatcagcacgacccggaaaaagaaaaatactatcaattaactagaagggaaaaagacgttctgactgaaatagcgaacgggaaaagcaataaagaaatcgcagcagccttgtttatttcagaaaaaacagtaaaaacccatgtatcgaatcttttagcaaaacttgaagtggccgatcgcacgcaagcagcgcttttcgcagtgaaatataacctgaatggagagatctcaaaatgaacatgttagtcataaatggcacgccaagaaaacatggcagaacaagaattgcagcatcctatattgcagctctgtatcacacggatttgattgatctaagcgagtttgtattgccggtttttaacggtgaagcggatcaatctgaactgttgaaggtacaggagcttaagcaacgcgttacgaaagcggatgcgattgtattattatcgcctgaatatcacagcggcatgagcggcgctttaaaaaatgccttggattttctaagcaacgaacaattcaaatataagcccgttgcattattggcagtagcgggaggaggaaaaggcggcatcaatgcgctgaacaatatgagaactgtgatgcggggtgtctacgccaatgtcatcccaaagcagctggtgcttgatccggtgcatattgatgttgaaaatgctacagtggctgaaaacattaaggaaagcataaaagagcttgtcgaagaactcagcatgttcgcaaaaacaggaaatcccggcgtctaaacgccgggatttgtttatgtgagaagggctatttgatcttcataagtcagctctgtggcatgatcaatataacggagaagggaatacagcatcttttctaaaacggcgtaatcctgttcaaaatgatacgcatgcagaaaatgctcaattcgttttgataacaaatcgtcctctgtacgcaccattaaaattaataaattatcccattgagaacgatgggtgtaatacagcgctttatcgtaatcggcataatccatgaatcgcttctcctttcttgggtgagaagttcatgattagtttatgccgcatcctctgttattgacggggcaaaacttgccgtctgcgtcagtaaaggggtagcaatatgagggagacataaaatcaaaatgcctgaatgaagatatcgcttttggtaaacctatgagggaacatattctgggtacaggagactgaaaaaatgaaatctctgccgtataccattgcgcttcttttttgcggattgattatcgtgtcaatggctgcaaaaggtcattcaacggacacaaacgagtccgttcaaaagtgggaacagcttgcctggagcaaaattcaggatgaatataagggtgcttcattttctgattatgcttatatggggcgtacagaggtgaatgatcagcagacgaaagatgtctttcgggtgacagtcagacaaaaagatgacactttttctgttcgggccgaagtctattttcatccggtgacaaatcatatgatcagcatcaacgtctttaggctctaataaaaaactgtacagccgttaaggccgcacagtttctgtttttagaaatatcgttttgcaccgagatagcgctgtttccagtaagagttattcatattggaaatgacaactccggaatcgttggcatttatgaattccccgttgcctaggtaaattccgacgtgggaagggccggctttatatgttgtaaagaaaacgaaatctccgacagcaggctggctaactgatttcattgtgttccaatatcccgctgccgttaatctagatacggatgtgactttgttcagtacatagtaaatgaatccgctgcagtcaaacccggacggtgtcgtgcctccccagcgatacggaaccccaagctgcgctttagcggccgaaatcattgtgttaatcttcgcactcgttgagctagtggtgtttgaagaaccggatgaagacgatgatgaagcttttccggaaatgaccagcttttggccaacctgcaagacatccgtttttaaattgtttttctcacgaatctgctgagctgttacattaaatttttgtgcaatcacccataaggaatcaccgcttttcaccgtgtatgtagtcgtcgtgccggagcttgcatttgacgaagaagacgacgatgatgaagagcctgaagatgctttacctgtcagcttcaatacttgtccaacgtaaagcacatctgatttcagattgttgatatttcggatttgctgtacagtcaggttatagttgtttgcgattttccaaagtgaatcaccgcttttaacggtatatttagttgttgctgaagtttggttcgatttggatgaattgtctttagaagacgtatcagagccgcttgattttgttttcaacacctgattcacgtaaatggtgtctgattttaagttgttcaagaccttcaattcagcgatggacatattgactttgtttgcaattttccaaagtgaatctccaagctgcaccttatatgttcccgtagaagatgaagaacttgaactcttattagaactgctttttgaactggagcttgaactcttattagagttgctttttttactggaactagagcttgaagaaacagtaccggacacctttaatttctgccccgcacgaattaaatcgctgcttagtccgtttaattttttcagttcctgcaccgtcattttaaactcatttgcgatcagccaaagtgaatctccgcttttcactgtgtaaacagaacttccgctcttcttggttgttgagcttgaagtagatgaagaagtgctggatttgctgcctggaatagtaagcgtctggccgatcgacagaacagtagtcgaaagatgattggcggatgtgagggccgccacacttgtgttataggtttgggccagtttccataaagaatctccgcttttgaccttaatcgttgctgcttcagctggtgtcactactaaagttgtgccgacaatcgcagatgctgtcagccctgctgctaatttctttttcatcttagctctcctttttcccccaatgattttgcatttgctgtttcttttttatatcggcacatttgtctcatcgttttgcctttttataaaaatagccaaattatcttaacaataagggggaaaaagggcataaaaaaagaaggaatcttaatctattccttcatttttaaaagcttcatgatatcttctttgtttttgacgaggtcgcgcagtgtgtatttgtctaaaactgcgaggtaggctaaaagcgcttcattcagcacatgttttaagccgcaaaccggggaaataacacagagattcttgttcgcatcaaaacattcaacaatattaaaatcgtcctccgtttttctgacaacctcaccgatgttgatgtcttcagggtccatgcctaatcgtatgccgccgccccgtccgcgtatcgtttctacgtagccgagctggccgagcctgtatatgactttcatgagatgattttttgaaatagaatacgtttcggcaatctgttttatatttgaaagttctccgggacgctctgcagccagaaaaatcaacactcttaatgaataatctgtataattggttaacttcataacaagacctcagaataagacattttctatatcttatcataatcgattgaaaaatgaaaaaaaaggaattaaaaaaacatgcacccagctgggtgcatgttttttgcttacatgtcattcggcggattttggtttttacggtttttttcgatttctgtgttttgcattttgcgttcaaatgtagacagataacgtgatgcaaaatccttaccgccaaggccgaaggataaaccgaaagcaagtgcgaagccgctaagtacgatgatgaacgcggaattgacgattgtcgcagcgacaccaagctgatccagggccataaagaaagcaagtgcgataatcgtatatttagcaataggcgctaaagacttgaattcctggccttttatcatgcttgagagcacttttctcaccaattctcctgcgtaaaggccgagtccgagaatgaatactgcgacaaggacattcggcagatacgcgatgatgccggtggcaatttctacgaggaagtgcaaccgaacaatttgaagcgcctcagctgtaaagagcagaatgacaatgatttgcgcaatcataccgacaacttgagacaaggacagctttgcaggcgttccggcttccatgcccattttccctaagacagaatcaaagcctgcgcgatggagcagtccggacaccatggatttcacccattttcctgcccagatacccgctaatacaagcacgatggcaatcatgatgttcggaagcatgtttaaaatcgtattcagcatagagacagctggttttgaaatgccggcgacatccagctgatcaagcgctgaaatgaccaccggaatcataatcagcacataagcgattgttccgatgactgctgaaaggcttgtgtcttttaagtaaattgataaacccatacgtgccgcgaatctttccgtgccgatgcttgcaaggaaattcgtaatgatatcacggacaaggcgggcaacaagccagccgattaatacgataagcgccgctgcaaataatttcggcagaaaagcgagcacgctttccatcatatttgtaaaaggacctgaaatgccgctgattttcaaagaagataagacccctggcagaaaaacaagcagcacgagataaaagacaatttgtgaagcggtattgacagcctggtgaatatcttttccttcagacaccaaattccacttgcgcagtttgtcactcgtgttcagcttcatcccgattttttgacaaggaagctcaaaacagaggctgcagcccatcctaacagcagaatgagtccggctttcagcacgcttgggatcgcagctgcaatcgccgaaagcatactgacaaacggcgatgccactgttgtcaggtgcaaaatgttaaagaataaaataaagacgatgatcagtgcgataaaataaacgaccttgcttatgactttttccgaggaatagcgtgaaggctttttcccagcaaagagcttgtcgtcgatttttgttttgctgagtcctttgtataccgctttttcaatgattttagcaatagcccagccgattaataagacgagtaaagcaatgattacgtttggcagcttactgagataagaagaaagcacgtctgctacattcaattggtatcgctcctttttcgtagtatggtgtgtgtttacccactgatccaataagcaaacagatgattgtgccgggggaattttttcttgcccgagtgagactatcatcttttgtatggcgggctcatacattatagataagtccaagtaggggggattcggttgaacgcggaggagaagaagggattacagcgggcaattgaggaaattaccgaaattgcaaaaggattcggccttgatttctacccgatgagatatgaaatctgcccggctgaaattatttatacatttggcgcgtacgggatgccgacaagattcagccactggagcttcggcaagcagtttcataagatgaagctgcactatgatctagggttaagtaagatctatgagctggtcattaactcagatccatgctacgcttttttgctggacagcaactcactgatccaaaataaattgattgtcgcacacgttcttgcccattgcgatttcttcaaaaacaactgccgtttccaaaacacgaagcgcgatatggtggaaagcatggcggcaacagctgaacggataaaacactatgaacaggttcacgggataaaagaagtggaatcttttttagatgcgatcctttcgattcaggagcatatcgatccgtcgttggtccgaccaaagcttcaatggagtgtggatgatgaggaagaggagattgaagaggcagccacgccttacgatgatctatggtctttggatgaaaagaaaccgaaaaaacaagtgaaaaaatcgaaaaaaccgttcccgccgcggcctgaaaaagatatcctgctttttatcgaggagcattcccgggagctggagccatggcagcgtgatatattaacgatgatgagagaggaaatgctttatttctggcctcagctggaaaccaagattatgaatgagggctgggcttcctattggcaccagcgaattatacgtgagcttgatttaacctctgatgaagcgatcgagttcgccaagctgaatgcaggtgtcgttcagccgtccaaaacaggcattaatccttattatttagggctgaaaatatttgaagacattgaggagaggtacaacaacccgacggaggaaatgaagaaaatgggcgtgcagcctgactccggccgggagaaaatgtttgaggtcagggagattgaatccgatatctctttcatccgcaattatttaaccaaagaattagtcatgcgcgaggatctttatttgtttcaaaaacagggccgagattataaaatcatcgataaacagtggaagtcggtgcgcgaccagctcgtaagcatgcgggtaaatggcggttttccatatttgacagtaaacgacggcgattatatgaaaaataacgagctctatattaagcattggtatgaaggaatagagttagatttgaaatatttggagaaagtgctcccttatttattccagctttggggaagaagcgtgcacattgagtctgtgcttgaggataaggaagtcatgttttcgtacgacggaaaaggtgttcaccgcagatatttataaaaaagaggatgcagcgttctgcatcctttttattttctagtttttaaaatattaaatatgatgtttgcctggtccgtattattaatcaatccgcggaatttttcttttccggggccgtacgcgtataccggtacttcttcgccggtatgatcggtactcgtccatccgctgttggagcgagtattaaaaatcttgatgatggctttgtaggcccctttgcttttgtcagcctgtgcagctgcttcaacgcttttgatttcttcagatgtgactttcagattgccatagcgggcgagcacatctttaaccggcttgccttcactgatttttttggccatgaattcaggtgttttcttagcggagagaatcggttctgcgtgccaattcttttccccgtttgcgccaatggtaaagccgccggttgtatggtcagcagttgcaatcacaagtgtgtgtttgtcttttttcgcaaattcaatcgcggctttataggcctgttcaaaatctttaacctcgctcatggctcctactgtatcattgtcatgggccgcccagtcaatctggctcccttcgaccatcaagaaaaatccttttttattttggttcaggcgatcaattgctgaaaccgtcatgtctttgagagacggtgttttactgtcacggtcgagcgctttagcaagccctccatctgcgaaaagcccgagcacctgctgatctttattttttttcaatgcttgtttagttgtcacatagctgtagccggcttgtttgaattcctttgtcaagtttctgtccttgcggttaaaataagattttccgccgccgagcagcacgtctattttatgtttgccttttattttgtcatccatatagctgttggcgatttggtccatgtttttccgtgattcattgtgggcgccatatgcggctggagtggcgtggttaatttcagacgtggcgacaagccctgttgacttgccttgctgtttggcctcttcaagtacagatttcactttttttccgtttttatcgacgccaattgcattgttatatgtcttaacgcctgtcgctaatgctgttccggctgctgctgaatctgtaatattatagtcagggtcatccggatgcgtcatcatcatgcctgtcaggttccggtcaaattctgttaacttcgggttattcggtgtgtcaccgttatttttcatggaacggtaggctcttatgtaaggcgtccccatgccgtcgcctatcatcacaatgacatttctgatctcagctttgtcttgttttttggcgctggccttttctgtttgctgaagctcagctccggcaaagattccagctgtaaggacagaaacagcggcgattggcagaagttttgatttcatattttgaaacaaactcatttttttcatgcctcctttaatgtattccgtttatcatgttagggaaattttgttaaatgcggctgctgatcatgtaaacaataagtaaagccttgtaaggaaatgaaaaaacgcttttcgttatcttgccttatttgatgtaaagcattcatttttcagaaaaatctttacctctctgtctttgcatgatatgtttgtttaaataaaaaaactgcggataaccacagctctcctcgaatattctttatcactcatttttccgatatatgagccgaccccgaaagtttttcatttatttcctttatgttgaaaaacatcccataaaacatgacaaaagcactcgttttttgtcacctttgcaacgaaaatgaaatatttaatacccttaaaaacttttttttagaacgaataattaagaaatttgtcacatgaagtcaagactatttctgatgggaatctatccttataatagaaatcaataagattaatttaaaaaaagagatacatatatagagagttaacatttggggaggaaaatatgaaaaagcaaatcattacagctacgacagcagttgttttaggatcgacgttatttgcaggagcggcatctgcacaaagcattaaggtgaaaaaaggcgacacgttatgggatctttcaagaaaatacgacacaacgatcagtaaaattaaatcagagaaccaccttcgttcagacattatttatgtgggacaaactttatcgattaacggcaaatctacaagttcaaaaagcagcagttcttctacctcttcttctacatacaaagtaaagagcggggacagcctttggaaaatttcaaaaaaatacggcatgacaatcaatgaactgaagaagctgaatggcttaaaatcagatttgcttcgtgttggacaagtcctgaaactgaaaggttcaactagttcaagcagctccagctcatcaaaagtgtcatcgtcttccacttctacttataaagtgaagagcggagacagcctttctaaaattgcgagcaaatatggtactacggttagcaaattaaaaagcttaaacggcttaaaatcagatgtaatctatgtcaaccaagtattgaaggtgaaaggaacaagcacaagcagctcaaaacctgcttcatcttcatcatcttcaagcagcaaaacgtcatctacatcacttaatgtgagcaaactggtttctgatgcaaaagcgttagtcggaacgccatataaatggggcggaacgacaacttccggctttgactgcagcggattcatttggtacgtactgaataaacaaacaagtgtgggcagaacaagcactgcaggatactggagttctatgaagagcattgccagcccgtctgttggtgatttcgtcttcttcacaacatataaatccggcccttctcacatggggatttacattggaaacaacagtttcattcatgcaggatcagacggcgtacaaatcagcagtctgaacaacagctactggaagcctcgttacctcggtgcgaaaagattctaatttttagagaaaacccgttcattggaacgggtttttttcattagacggagcacaggcgttttggttgctcctaaaaatgaaaatgtgataaaaaatccaagaattttttttctttcttattttcataaagggcaatcgcgtaagcgccggcatagggcagctgtacagactgataaggaattctgatcatctgtttctctgctaactcacgctttactgtagataaaggcagaaatgaaactccgagtccttccttgataaaccgtttcgttatatgtgtttgagtgaccttcattgttctcacaaatggaaatgtcattctgacttgacggagcaagtcgtcccagtaatcaggatgattgtgggtcaaaagcaggtattgttcgagcacctctttggcatcaatttcgttgtcttctatgaaacgcttatcgggcggggcaacaaggacgacagggtctttgtataagcagtggcagcttaaagaagaagactgtacctttaaacagcttagtccgatatctgcttccccggctttaatcagtgacgcgatttccgctgattcgaaaatcgtaaccgccatttctgtttccgtattcattgctgtgtaccgtttcatgacagaaggaagcacagtatctgcaataagcggagaaaccgcgagctgtaaggtttgagagtagccttgtctcactctgtgaagttctgccatgctgttttcataatcatcaagaagcctgagcgcatacggcaaatacgccctgccttcatcagtcagctggatttgcctgcctttacgctcgaacagcttgcagctgatttctttttctaattgcttgatatgtacggtcacagtaggctgagataagaaaagcgtttccgccgtttttcggaagttctcatattttgcagcggtcacaaaggtgtgaagccatttgaaatccatttctattctccctctgattaatatttttaattaattccctttaaaatattcattattttttaaatattatatttactataataacagaaaaggatagggggaatacaaatggtacattacggattaaagggaattacatgtgtagaaacatccatcagccatattgatggtgaaaaagggcgtctgatttacagaggacatcatgcaaaagacatcgcactgaatcatagctttgaagaagcggcttatttgattttatttggaaaactgccttcaactgaagaattgcaggtatttaaagataagctggctgcggaacggaatcttccggaacatattgagcgcttgattcaatcactgccaaacaacatggacgatatgtcggtgctgagaacggttgtttcagcattgggggaaaatacgtacacattccatccgaaaacagaagaagcaatccggctgattgcaatcacgccttccatcattgcatacagaaaaagatggacgcgcggtgaacaagcaattgcaccttcttcccagtatggacatgtcgaaaactactattatatgctcacaggtgaacagccttcagaggcaaaaaagaaagcacttgaaacctatatgattctggccatggagcacggcatgaacgcatccactttttcggcacgagtcacgttatcaacagagagtgatttagtgtcagccgtcacgtctgctctcggcacgatgaaaggtccgctgcacggaggcgctccttctgcggtgacaaaaatgcttgaagacattggagaaaaagaacatgctgaagcatatctgaaagaaaaactcgaaaaaggagagcgcttgatgggattcggccacagggtgtacaaaacaaaagacccgcgggcagaagctttaagacagaaagcagaagaggtggccggcaatgaccgtgatcttgatcttgcgctgcatgtagaagcagaagcgattcgtttgcttgaaatctacaaaccgggacgaaagctgtacacaaatgttgaattttacgcagctgcagtgatgaaggccatcgattttgacgatgaattgtttactccgaccttttcagcaagccgaatggtagggtggtgcgcccatgtgctggaacaggcagaaaacaacatgattttccgcccgtcagcgaaatatactggtgccattcccgaggaagttctttcataacatattttggcgtttattcatttctgtcgtgtggtaacgttcagtatcaaccacatgtctaggagtgatgaatgtgaacccaatggacagacaaacagaaggacaagaaccgcagcatcaggacagacagccgggcattgaatcaaaaatgaacccgctgccgctgtcagaggacgaggattatcgaggaagcggaaaactgaaaggaaaagtcgcgatcattactggaggcgacagcggaatagggagagcagcagctattgcctttgctaaagagggggctgatatctccattctatacttagacgagcattcggacgcagaggaaacacgtaaacggatcgaaaaggagaatgtccgctgcctgcttatcccgggagatgtcggggacgagaaccattgtgaacaagctgtgcagcaaacagtggaccattttggtaaactcgatatcttggtgaacaacgccgctgaacagcatccccaggacagcattctcaatatttcaacagaacagctggaaaaaacctttcgcacaaatattttttccatgtttcatatgacgaagaaagctttgcctcacctggaagaggggagtgccattattaatacgacatcgattaccgcttatgaaggggatacggcgttaattgattattccagcacaaagggtgcgattgtctcctttacgcgttccatggcgaagtcgcttgcagataaaggcatcagagtgaatgcggtggcgcccggtccgatttggacaccgcttattccggcgacattccctgaggaaaaagtgaaacagcacggcttggataccccaatgggaagaccgggacagccggttgagcatgcaggcgcctatgttctgctggcgtctgacgaatcttcctatatgacagggcagaccattcatgtgaatggcggccgttttatttcaacgtaatcaacgaaaaaccagctctagagctggtttttttgtgtggtaaaaaattaaaaataaaaaatttgtcgatttttctaacaattttgttttcatttttgcaattttatatataatattgagtaggagaaaggaatgattcgcgaccagtacaaatatagtagaaaaaaagaaaaatgaccaatgttgctcatgaattcagaaaattcaaataaaatatataaaaatagatgatcgggagttgaaggggaatgaaagggagcgtttttaggaagaaaagcattcaggatttaatcgctgcgacgagcggtgaaaagtctttaaaaagagaattaggggcatttgatttaacgttgcttggaatcggcgccattattggcacagggatttttgttctgacgggaacaggtgcagtcacggccggtcccgggctgacgatttcatttgttgtggcggcgctggcttgtttattcgccgccctgtcttacgcggaatttgcgtcaagtgtgcctgtttcaggttcggtgtatacattcacttatgccacattgggagagcttatggcctttattatcgggtgggatttaattttagaatacatgctggcggtaagtgcagtgtcggtcggctggtctggttatttccaatcgtttttatcagggctcggcattcatcttccggttgctttaacagcggcaccgggcgcagtgaaaggcacctttaccctgtttaatcttcctgcattcgtcattgtaatggcgatcacatatttgctttatttaggcatcaaagaatcaaaaagagtcaacaatatcatggttatcttgaagatactggttgttctgctgtttatcgcggtggcagccgtttacgtgaagccgcacaactggcagccgtttatgccaatgggctttggcggcgtgttcagtgcagcggcgctcgtattctttgcttttatcggatttgatgctgtatcctctgctgcggaagaaacgaaaaatcccgcgaaggatctgcctaaaggcattattttctctttattggtttgcacgattttatatgtcaccgtatcagcgatcatgactggggttatcccgtttgctcaatttgcgggtgtggatcatccggtttctctagttcttcaaagcgcaggacaaaattgggtggcaggcatcattgatattggcgccgtgctgggaatgacaacagttatgctcgtcatgctttacgggcagacacgcgtcatgtttgccatgtcgcgtgacgggcttgtgccgggctcactttctaaagtgcatccaaagcacaaaacaccttatgtagccacttggtttttcggaacgatgtcggcgcttctcggctcacttgttccgctggatgaacttgcaaagctggtgaacatcgggacgctgtcggcatttgtactgatttctgtggcagttatcgttttgagaaagaagcaaccggatcttccgagagcctttaaatgcccgggagttccgtttatcccaggactggcgattctgttctgcctgttcttgattttaaatctggggtgggtgacgattgtccgcttcctagtgtggctgttaatcggcttggtaatctatttcctgtattcaagaaagcattcaaaattaaatcaataaccttttgataaagagagcggccatacaggccgctctcttttctgttcttggcaaatgaatctatagaaatgaagacaaaaataagagataatataggctggaaaggaagtgacgtttattgtctgagcaaaaaccagtccaatgggcttcgaaaatcggtttcgtcatggcagcggccggctcggctatcggcttgggcgcgatttggaagttcccttacgtagcggggaccaatgggggaggagccttttttcttatcttcgtgttatttaccatcctcttaggctatccgcttttggtgggggaatttatttttggaagacggaaccagacgaatgccattgatgcatataaaaaagaagcgccgcgatcagcttggtttcttacagggtggatcggcgtagccgcgtgtttcttagtgctgtcgttttacagtgtaatcgggggatggattttgctgtatatcgtaaaaacggcgtcaggctcactgtccgggctttctcaagcacagtatggcgctctttttgcttctattatccaaaatccggtgcagacgctcgcggctcagcttgtctttatggtacttactgtcatcgttgtcgcaagaggggttcaaaaagggattgaacgggtaagcgcggtgatgatgccgattttgtttttattgtttattctgctcgttcttcggtctcttacgcttaatggtgcaatggaaggcgtaaagtttctgcttgtgcctcatttcggcgatctgactccggaatccatattattcgcgctgggacaggccttctttacgttaacactgggggtttcggtgatggtgacctacagctcctatttgccgaaaacacaaaatatccctcgttcggcagcctccattgtcttgatgaatatcattgtgacactcttggcaggtttggctatttttccggcggttttctcattcggttttcagccaaatgaaggaccgacactgctgtttacagtgcttccggccgtttttgaacagcttccgttcggcacgttgttttttatcggttttctcgttgcatttttatttgcagccttaacctcagcattttcgatggttgaaattatcgttgccacaatcggaaaaggggacgaaaagaagagaaaaaaactgtcatggacgagcgggcttttgatctttttggtcggaatcccatgctgcttgtcttatggcgtattgagtgatgtgcacctatttggcaaaacattttttgatattgccgattttaccgtcagcaatgttttgatgccttcaggcgctctgttaatttctctatttatcccgctgaaaatttcgaaaagcgaactcttggctgaaatgcgaaatggatcaaatgcaggtaaagcattcttttactcgtggttttatttgcttcgttttatcgtgccgcttgccattattatcgtgttcttaaatttaatcggaattttatcattttaaaaaaacaggctccgtttccggggcctgttttttatttaataagatgatatcaacggtgcccatgccgttttcagtttttggatgccgagcctgatgtcctcttctgacaaaccgccataaccgattaagacagaagcaaaaggcgtctgttctttatatgagggagacacgggatagatggttacaccgtggtctgcggctgcttgtattgcttcttcctcacttgctggaaacaaaaggcgcagcagaatgtgaagccccgagttcttaccgagaatctcaacggtgtttcccagttcagagcgaatggcttctaacaggatagcgtgtttttttcggtataagcttctcattctatttatgtgtttctgccactctccggtttcgatgaagtctgccagtgccaattgcgagtgggcagaaacggtctgcttcattaactgagcattgttttggatcggttccatgagttcagggggcacaatcatgaagctgagccgcaaggaaggcagaagtgactttgaaaaagtgcccagatatatgactctgccattcggatcaagaccctgtaaagacggaatgggatggccgctgtagcgaaattctccatcgtaatcatcttctataatgaatgaatttgtttctgccgcccatgccagcagctcctgtctgcgggtaatcgtcataatggtcccaatcggaaactgatgcgaaggagtcgtatacatgagataaggattctgacggtagagctcatccggcaggacgccttctgcatcagaacaaatcggagtgacatccatgtgatttgcttcaaacatccttcttgaacggtgaaagcccggttcttcaaagccgatttttgtacctggctttagcgaaaggcaaagaatttgcagaagcacggtggttcctgcgccgatgataatctggccgggttcgcaatttactccccgagacagcctgacgaatcgggcaatcatgtgcctgagttcgtattctccttgaggatcgccagaggtgtgaaacgatccggaatagcgatcaagactttttactatgctttttctccatgcgttaaagggaaagagggtcggatcaacgctgccctgatggaagtcaatagaaggtgcgtttttttgatgtaatcccggctgtacagactgctgaaaatggtcaggagctgtcgggaatcctggttctacttccgccgcgaaccagccgattttcggcttgcttttgacatagccctcagcagttaattgctcataagctcgttctatagttgccgtgctgacatcgagcaagctggagagcctgcgttttgacggaagtcttgttccctttgtgattcgcgcatgtgaaatttcttgtttaaaaaaggtataaagctgttcatacagcggtgttttgctctttttatcaagaaacggcgtaatatccatctcatgtctcctttgtagctggcatggtcattttttctgatattggctatttggcaaatgccatttattagctatgatcattgtaacgaaaggaaaggggattgagaagatgatccatatgaaacaattaacctcgaaagaagaatgggctgagtcgtatccgattatgagtgaattgagaacagaactggatatagagacgtatttacaaaggcttgaagcctgtgtgcagaaagaatcgtatatgctgtttgccttatatgaaaatacagcaatcagagcgctgtgcggggctctgccgagagtttccattcataaaggagagcacttgtggattgcggatcttgttacaacggcaccttgccgatcaaagggatacggcaaaatgcttttggattatgcctcagactgggcgagaaaagccggactcggttttgtcagtctttcatctggcctgcagcgtaaagacgcacatcgattttatacagataaaatgggttttactatagaaagttatttgttccgaaaaccggtataaaaaagacgcctgaaaaggcgtcttttttaaaagccaaactgtaaattcgtatctacagatacaatggtatacacacaaataatcacaaagagattaaggatgacgccgagcaggccggggcctgtgcgccctctcttgatgaagagttcaacaacgccgaacggaacggcagccatggcgaacggaagcatttgataggaataaaacgtgacattgctgataatggccaaattcagcaacagcagggacagaaccgctgtcccgacagagatccagccgaatacattgtgttctttaaaaattcttaccagttccataattccacctcgccgacattcgctgattttacagatttatttttcagcatgcgctggatttccttggttggccctgtaacgaccgaaccgtatacattgacaccgtttttttctacataatctaatcggttatctacattcaggtctttccgttttgaaatgacctgagcccatttttcgtgtttggacatgaatttcagggcgttgataaactgatcgccattcgacttgccttttgtattaagggcggccaagaactttgaatcctttccaggatagccaagaggttctgtggaagctgtcttatttgtgtttttctctgtttcgattgcgttccacaaaaagctcacatcatagcctttgaatttgttatacacgtcttttgtcggatatgcacggtcatatgaaaggtagacctctgataccgttccttcaggcaatgtgcttaacgttttttctgcttttgcggtcgtttgttcagacttgtttgaaggatgtgtaaagtaatggccggttttattcacttctaagtcatagtagtttactgccggcgcttttactttgttataaaacatttcaacccgttcattccctacggcagccgtcttcgttccaatctgcttttgcagcgggaattccgtattcattccaaatagcttcacttggcttttcagtccggaagtatcaacaagaacattcggcatggtcagggctacagtgactgcggcagtttccataaactcattgccggtgctatgttttccacccattccgtaatagaggtagcttcccagcgtacaaagcggcaaaatcatcaatgtcgaaatgacggcaagcacagaaattcgcaaataagacttgcgtttgccgtaggctaaaatcgctttttgtttttcaggactgatgctgagatcccaatcgttatcgtcctctagttcgctgtcaatcagttcctgatatacttcgagcttctcaagttcttcctcaaatgcagtcatttcctggtcgctcatttccccatttttatattgatcaaaacgctttttaaattcttcattcatcattaacacctctattataaagtgctttcagccgctgtctggcacgaaataaaacacttttaaaattcgcctctgaaatattcataatatgggatgcttctttgtagtttaactcttttaaataatatagcgttaaggcctcccgataattatcggggagctcggacatataaccagtcagcacttcctttatctctacctgatgggctggactttgaacagcattttgaaagaggcttccgattaagtcatcagaaatggttacttctttcttatgctttctgacgtaatcaatgaaggcgtttcgcgccacttgaaaaagccagggctttactttgctgtgatcataggagtgaatgtgtatgtatgcccgcataaaggtttcctgcagcaagtcttcagcaagatgcttgtcttttgtcatggagagcaggaacctgtaaacatcattcatgtacatttggtaaatttcatcgatcgtcactgccttttctcccctctatgttatacacgcataagaaaggtttaaagttgcacattacatgcaaacggcttttttatacctaatcaaacaccattactatatagtacccaaaaatggccgcaaaagatagtgcggagaaatgtttaacattttttccagaggggaaaagatagtgaaaaagtgaaggagtggcacaatggaatataccagtatagcagatacaggaatagaagcctccagaatcggcctcggcacatgggccattggcggaacgatgtggggaggcactgacgaaaaaacatcgattgaaacaatccgcgccgctcttgatcaggggattacactgattgacaccgcgccggcttacggcttcgggcagtccgaggaaatcgtcggaaaggcaatcaaagagtacggcaaaagagaccaggtgattctcgcaacgaaaacggctctggactggaagaacaaccagctgttccgccatgcgaacagagcgagaattgtagaggaagttgagaattctttgaaacggcttcaaacagactatattgatctttatcaggtgcattggcccgatccgcttgtgccaattgaagaaacggctgaagtcatgaaggaattatatgatgcgggaaaaatccgggcgattggcgtcagcaatttttcaattgagcaaatggatacatttcgcgccgtcgcacctctccatacgattcagcctccatataatctgtttgaaagagagatggaagagagtgttcttccttatgcgaaagataacaagataacaacattattatacggcagtttatgcagagggctgttaacaggcaaaatgaccgaagagtatacatttgagggcgatgatctgcgtaatcacgatccaaaattccagaagccccgctttaaagagtatctttctgctgtcaatcaattggataagctggcgaagacacgttatggaaaatcagtgattcacttggctgtcagatggatcttagatcagccgggagcggatatcgctctttggggagcaagaaagcctgggcagcttgaggccctatctgagattacaggctggacgctgaacagtgaagatcagaaagatatcaatactatattggaaaatacgatatcagaccctgtcggaccggagtttatggccccgccgaccagagaggaaatataacaaaagctgagggcgaatcctcagctttttggcgttttaacgggagaaatcttaaaaattagtaccaggtaataaaaaatgttgttataatagatgacagaaagaatcattgattacgacaaaggaagtgcgatatgtataagttttgtgcaaatgctttaaaagttattctttctcttcgcggaggagtgaaggtgtataacaaagaaaaccttccggccgattcaggttttgtcatcgcgtgtacacattccggctgggttgatgtgattacactcggagtcgggattcttccttatcaaatacactacatggcgaaaaaagagctttttcaaaataaatggatcggttcgtttctgaagaaaattcatgcctttccggtagatcgggaaaatcccgggccaagcagtattaaaacgccgattaagctgctgaaagaaggagagatcgtcggtatcttcccaagcggaacaagaacctctgaggatgtgcctttgaaaagaggtgcggtgacgattgcgcaaatggggaaagcgccgcttgtccccgctgcatatcagggcccttcaagcggaaaagaattattcaaaaaaggaaaaatgaagctgattatcggtgagcctcttcaccaggctgattttgcccacctgccttcaaaggaaagacttgcagcaatgacagaggctttgaatcagcggattaaagaactagagaataaacttgatcagctataaggcgttctgagagattgccctgaactgtgaaaataagaaaagcaccttatacaaggtgcttttcttattatgcttcctgctggttagctgtctccagaagttcttcttcttgaagctttttcacttcaatatatgcgacgtggtggccgtcaatttcattaatgatgaattcgcagccctcttcgatgatggaatcatctttttcaacatcgtatttttgagtaaggaaccagccgccgattgtatcgacttcttcgttctctaaatgaatgcctagcaggtcgtttacttggtcaattaacacttttccgtcaagaatataatggccttcgccgattttgcggatttcgctaatttcatcaatatcaaattcgtcgcggatttcaccgacaatttcctcaatgatgtcctcaaccgtcacaagcccggcagtaccgccgtattcatcagacaatatggccatgtggaccctctctttttgcattttgacaagcaggtcttggattggcgcagattcaatgacatgaatgatcgggttgacgaattgagaaatggtggaatcaacagatacctcaccgcttatgcaggctgtcagcacttctttaatgttaataaccccgataatgttatctttatcgccctcttccacagggtagcgggtatatttttcaatctgaatgatgtccatcatttcagaaatcttgatatcatgcggaaggctgacaatttcggtccgcggaatcataatttctttcgcgagcctgtcgtcaaattcaaagattttattcacatatttaaactctgattggttgatttcaccgcttttatagctttcagacaaaatgattcgcagctcttcttctgagtgtgccagttcgttttctgaaacggtctccaggccaaatgctttggtcaataaccgtgcggaattgttcaaaagccaaatgaatgggaacgcgatgcggtaaaaccaaatcagcggtttcgcaaacagcatagacactgcttccgccttttggatagcgactgttttaggtgcaagttctccgacaacaacgtgtaagaacgtgataatggcatacgcaaaaataaacgatatgacatgtgaaagggaacctggaacgttcatttgtacgaaaagcgggtgaagcagcctttcaatcgttgattcacctaaaacccctaatccgatggaagtcaatgtaattccgagctgacacgcagataaatattcatcaagatgcgtggtcactttttttacggctattgctgctttatttccttccgcgatcagctgatcgatccgtgagcctctgattctgataatggcaaactcagatgccacgaaaaatgccgtcagggcgattaaaacagcaactaaaatcaaattcactatgtccaattagaaccttcactctagcaatgagaatgaaggtaacacctcctgttagataaaatggttttaacttaacagcagcataaatgattggaacacggcgagcttttcaggcgggagtttgcttttcagcttgtcacgatcctcgggcttcagccgttcaaaccgatgcaagattccggagatgttttgattcatatgatcaatttctaatgccagatttccaatttcatcatcaagtttagctgaagagggaaactggttctccagtcgatctttaatatcggacagggccaatcgctgcttcttgcaatctacaataaatataagtcgtttgagtgcattttcgtcgtagtaacggtaatttgaacaggatctggccggcgtaagcagaccgagattcgtataataatcaactgtccgtttcgttactccggcgagtgccgctagttcactgatgcgataagtctcagccccatctatatccctcccaaccatcacgttatagttatgagaatagtttaatatatgaacggtgtcttgcacaagtttattgtttttttcagaccggaattggaagttgtggaattcatcatctgattgaagtaacataggaagatagaattttcaaatttttatatgcggaagggacagatgaaattggctgggttatcccgggaagttgaagaaaatttaaataaaggatcatggattcgcaagctgtttgatgaaggtgcaaggctgaagaaggagttcggggaagaccaggtatttgatttttcactcggcaacccgattgttgaaccgcctgaagcttttaagagagcgttaatagaggaagctgaaaaaggcagccacggatacatacaaaatcaagggcttcctgcagcgagagaaaaagtcgcgcaatttctggggtcacgttttgaagctgatttctcagcggagcgtatcgtcatgacggtgggtgcgggaggcgctttgaatgttgcgttaaaaagcatcgtaaaccctggggaagaggtcattattctcgcaccttattttgccgaatataagttgtatattgagaactacggggaaaggccgtcagctgcccgttgacaagccggtttgagatcgacattgaagcggtaaggcaatcgatcactccacagacgaaagggctgatcctcaatactccgcataaccccacaggcacggttctcagccagaaaaatatagacgatttaggcgctttattaaaagaaatagaagagaagagcggccagacgatttatgtgctgtttgatgaaccgtacagtcaattaatctatgatgaagagctggcaaatccgtttcaatcgtaccatcgtgtgatattggccagctcattcagtaaagatctcggcatagccggggagcggctcgggtatatcggattggacagccgaatgccggatgcggaccttttgatcaacgcttttgtgtattgtaatcgaacgcttggatttgtgaatgcccctgtcatgatgcagcgggctgtggcacgaatggatgatttaagagtagacgcgagcgcttataaagagcgccgggatttaatggtagacattttaaaagaagccggttttgaatttgaaatgccaaagggaggtttctttgtttttccgaaatcgccgattgaagatgaagttgcattttgcgtgcatgccgcccaaaaatacaaattattaattgtgccgagcagcggttttggaatgagcgggcatttccgattatccttcagtgtgccgatcgagcagattaaaaactcacgggacattttcatttctttatataaagattttgcttaagaaggcaaagaaaagaaaacagttttcaaggctgttttctttttatatccacaaaatccttcctcttccaatccagacaggcgcagaattgacaagcaggcatgcagttaaggctttcttcatgataaaagtctaaaaattaaaaatcatttttggaatgagttgtgttacaataaaatatacaatttataatcaaactttgacttttggaggtggtatgatggggccctctgcttaggcaacaatacaccgcgtacctcaatgttaaggaaaaatgattatatcaggaggtgactccttatcctttgttgagaggatagggttaaatggacgatattgacagtctgattttaattggcgtgctcattgctttaaccgcgtttttcgttgcaagcgagtttgcgattgttagagtaaggagatccagaatagatcagcttatcacagaaggaaacaaacgggcgatactcgcaaggcgtgtcattacagatttggatgaatatttatccgcatcccagctgggcattacattgacatcaattggacttggcgtactgggtgaaccggcctttgaacggctgctgcatccactgtttgaaccgctcggcttgccagactcggtttcacatgcagcctcttttgcagtcgcgtacggcttgatcacgtttctgcacgttgttgtaggtgaactggccccgaaaacggtcgcgattcaaaaggcagaacagctgactttactgatagcgggccctttgcgtttattctatttgctactgtttccatttatttggatcctcaatggatcggcgcggcttttatgcgggatgttcggtttgaagcctgcgtcagaacatgatggttcccattctgaggaagaactcaggatgctgttatctgagagtttaaaaaacggagagattaatccgtctgaatataaatatgtgaataagatttttgaatttgataatcggatcgccaaagagattatgataccgcggaaggaaatggctgctgtgtcaactgagatgacaatggccgagatgctcgaagtcatgctgaaggaaaaatacacgcgctggccagtcacagatggagacaaagacagtgtgatcggtttggtcaatacgaagcatttgttttctgatttgctgtttatgacagaagaagaacgaatgaagatgacgatccatccgtatgtgaggccggtcatcgaagtgattgaaacgatcccggttcatgacttgctgattaaaatgcagcgcgagcgcattcatatggctatattgtcggatgaatacggaggaacctcgggacttgtgacgacagaggatattcttgaggaaattgtcggagagatcagagatgaatttgatgaagatgaacagccgctgatccaaaagcttggcgacggccattatgtgatggatggaaaggttcggatcgatcaggtgaacagccttcttggcgcatcgattcaagaagacgtcgatacgatcggcgggctgatattaaaagaaaacatcgatattgaggctggtgaatccattcgcatcggttcatatacgataaaggtgctgaagatggacggccgattaatcaagcaaatcgatataaaagaagaagccggcaacacaaccgggattacggcgcaccacaagctgccgctgcctgagcctgtgatgctgaacagtgcaaccttgagcgagaaataagctcaaggtttttttacattgtgattgtccagccgcaccaaaatgtcaaaagcgatccgcaaagtgttagggcgatgtacaagatgctttctattacacgtttggccataaggagttgaatactttcaacgctgaaggtggaaaaggtcgtaaaggcgccaaaaaaccccgtgccgatgataagcgagaccgaagcatttgcaacgtgaagtcctgtaaatattccgagcccgagagcaccgagaatattgactgtcagtatgccaatgggcaggctcagacctttggttttggcggttatgacattgccaagccagaagcgaagcattgcgccaagtccgccccctatgaaaatacccgctagtgtcatctttcctgcagcccctttctttgctgaatgcctgctatgcgccgtcccgcaaaaacaccaatcagtgcaaatatgatccctgatatcaatgaggctgccacatataaaagagccaatgagggttgtccttgcaaaagcatcactgtttccttagaaaacgtggacattgttgtgaagcctccgcaaaagccggtgcctaaaaaagccgacagcagaggccgttttgccccgatcataaaaaatccggtcaaaatgcctaatagaaggctgcctgccgcattttccagccaggttgccgccgggaactgaccggtgtgtatccataagtttaatccgtatcggaggcaggcgccaagcgcgcctccgataaaaaccgcgctatatattttcatgtttgccatcctttatgatgaaatccgggtaatctgtaacgatgccgtccacgcccatggcttgtaattttgccgctgtcttttgattgttgacagtccatgcaaatatgtttaagccatttttatggacggagccgatcatcagacggttgagccgtgtgtattttatattgacatagtttgcaaaagagcggaaggccttcatctgatttctggacagcatgccaaagttgggccttgtaatgaccgctgtcggaatcgaaggataaagctcgcggaacctttggacggagcggaactgaaaggattgaacaatattattgatagaaaaagaaaattgccctaatagctgtcccacctcttcttcaattccgacttgagacggatggccttttagttcaattaaaaggccgatttttttgtggtagcgcttgagcaccgcttccagggtcggaatacgctctccttgaaaagcgggaccgtaccagcttcctgcatcgagtttttgcaattcctccaaggtaaaatccttaacaaagcccgatccgtttgttgttcggtcaaccctgtcatcgtgtatcacaacaatctgcctgtcttttgtaagctggacatccagttcgatcatatctgcattcattttcaccgcaaggtcaaatgcggcaatcgtattttccggagcgtagccggatgctccgcgatgggcaatgatgtacaagctaagtcagctcctcgtatgggcatttctgttattgtatcaaatccatatatgcaccgcgatacaaactggtgaattttttctgccatatcggaatggtccgggctgaggaatgcgtataactaaaaaaagacactcagcgtatcagaacacatttcgtcagaaaattaggtctttcgacatgttcacaacaaaatatgatcctttataatagcaaaaaaggaggcgagatcatgggaaaagggagaatcagagtggaggaaagaattaaagccgaaacggatgctgaaatgcaaaaagcaactctccttgatcagacacaaacgaaaaaaggtaagtgactgtccctattgaatctggctgatagatgaattgagaaatgaccccggcgtttcgccggggttttgtgctgcaaaagacatttaaatgaacatctttacgaatattttagtataataaacaattgattgggatagaggggagacagtcatgccggattatctgcagcagtattttacgcttgatatcatcattcaaatcggcatcagcttggcgattttgctggtgtttcttatacttagaaaattattcacaagatatttctttaacctgctttttaatttgacaaaccggccgaaaacagaaatttttaaacaggtggttctggcgtttgataagccggccagatggttttttgttgcccttgggctgtttttagcgatccggtattcaccgtttttagatgagcaaatgccggtcatcagcaaaatataccgctcactgattgtggcgctcttgtgctggggtctttgtaatttgaccgcaacatcgtcgtttatcttccataaggtgaatcagcgctttgagcttgacatggatgacattctggccccgtttttatccaaattgctccgttttgtgatcattgcgctcagtgtcagtgtgatcgctcaggaattcaattatgatgtcaacggatttgtagcgggccttggtcttggcggactggcttttgcgcttgccgcgaaggataccatcagcaacttcttcggcggtattattattattactgaaaagccgtttacaattggtgactgggtggagacgtcgacagtaacaggatcagtcgaggatattacctttaggagcacgagattcagaacagcacagggggcgcttgtaacggtgccgaactctacgctgtcgatggaagcgatcacgaactggacaagaatgaccaaacgccagattacgttttccatccatgtgtcctacgctacgccgattgagaatcttgaacgctccattcattctctcagaacaatgctcttagagcatgagggcgttgataatgaaacaatcatggtcaactttgatacgtttgccgacagctactacaatttattttttaacttctatacaaaaacgacggtttgggctgaaaaccttaatattagagaggatatcaactataaaattattgagattttaggtgcagaaggtgtccagtttgcatatcccggccaaatggttgttgtcaagcaaaagcacgaaagcgacccattccaggtgaatctaaataaagaggaaaaggaacgggcttaaaagagagacttcgtctgacagaggcggagtctttttcatggtaaaataagagaaaaaggcggtgttgagttggaagcattcaaaaatattctacatgaagcacagcgaattgttgtgctgaccggagcgggaatgagcacagaatcagggattcccgactttcgttcagcagggggcatttggacggaagatgcctcaagaatggaagcgatgagccttgattattttttaagtcatccgcgtctgttttggcccaaattcaaagaattgttccagatgaaaatgagcggcagctttgaaccgaatgaaggacacttgcttttagctgagctggagaagcaagggaagcaggtcgatattttcacgcaaaacattgacggtcttcataaaaaagcggggagcaggcatgtatacgaactgcatggttctatccagacagcagcttgtccggcatgcggcgcccgatatgatcttccccatttgctggagcgggaggtgccggagtgcacgtcggccggaaacaatggggacatttgcggaacggtattaaaaaccgatgttgttctctttggcgacgccgtcatgcactttgacaccctttatgaaaagctggatcaagcagatcttttattggttatcggcacgtctctcgaagtggctccggctagatttgtgcctgaggatgcaagtctgattcccggcatgaagaaagtcatcataaaccttgaaccaacgtattgcgacagcttgtttgacatggtcatccatcaaaaaatcggtgagtttgcccgaagtttgggcataaaaaagtgagccgccttatgcgcctcacttttttattcatgaacaggaaccattgtgtcctctaacactccgaaggaatagcctttttcttttaatttattgattagtaccggcagcgcgtttacggtagcgggaagatcatgcatgagaatcacattcgggcggcctgaagagctgtgttccatattttcaagctgctctaacacggccgtcacatactttgaatttcggtatttccagtccatgctgtcaatcgtccaatcccagtacacaaaaccgtctttctcaagattgcggatttgtgagggggttagtgacggcttgcttccgtatggcgttctgacaagagcggttttatatcctgtaatgtcctgcagcgtgtcacgcgcctcctgcatttcttttagcggagatgtcggtgtttgatagaacaatctgttattgtgggtaacgccatgtaaaccgagtgcgtggccttccttttctgctcttttcacagcttgtttgaattcgttcatccgcggtgacagcataaaaaacgtcgcttttacatcagcgcttttcagcacatcgagcaagcggtttgtaaaggctgacgggccgtcatcgaaggttaagtaaaccgttttatctcccatgtcctgctttgtctgcagatgttttatcagcagatcgggggagtcgtttttcagcttaaggctttccttctcatctcgaagctgtccgttagttgtgacagtgacttcctttgctttcgttaaactgttagaataacccaaaatcaccataagcaaaagcagcacacataaaactgctaaacttgcaaatttaaaagcaagcgaaactgcagaaggagaagcctctcctctcgtttgtcgcataacaatctctccattggcataaaatctctacataatgctgtacagcaggcagcttatgaagatgccttatgtttacaacctatgtattaccagtcaagtatacaggaataaaactggaaagcacatagaaaatttgtcgaaatgtcagattttaaggaaaaaataaactcctttccgctatagatctcttgatctttctgtttttcagcttgtccaatatggtagaattagtgacaatgacagcttgaatgacatcagggacatctcgaaaagggagggcttttatgaaggttttagtcaatggccggctgattgggcgcagtgaagcatcaatcgatttggaagatcgcggttatcagtttggtgacggcatctatgaagtgatcagggtgtacaaaggagtattgttcggcttacgtgagcatgcagagcgttttttcagaagtgctgctgaaatcggaatttcactgccattcagtatagaagatctcgagtgggacctgcaaaagcttgtacaggaaaatgcggtcagtgagggagcggtatacattcagacaacaagaggtgtggccccgcgaaaacaccagtatgaagccggcctcgagccgcagactactgcttatacgtttacggtgaaaaaaccggagcaagagcaggcatacggagtggcggccattacagatgaggatcttcgctggttaagatgtgatatcaaaagtctgaatttactgtataatgtcatgacgaagcaaagggcctatgaagcgggagcatttgaagccattttgcttagggacggcgttgttacggagggtacatcctctaacgtttatgccgttatcaacggcacggtgcgaacacatccggctaaccggctcattctcaatggaattacacggatgaatattttaggcctgattgaaaagaatgggatcaaactggatgagactcctgtcagtgaagaagagttgaaacaggcggaagagatctttatttcgtcaacgacggcagaaattattccggtcgtgacgctcgatggacaatcggtcggaagcgggaaacccggaccggtgaccaaacagcttcaggctgcttttcaagaaagcattcaacaggctgctagcatttcataaatgaacgaagaaaagagcccgctttttacagcggggctctttttattttttaacaaatccaatcaaaatggagatcattggcgatatatagaggaagaacgtaaacgggatgtagtctatgactggaacaccaagtgcgctcgccataaatgcgccgctgacgccccaaggaatcaatgggttaattaatgttccgccgtcctctaatgatcttgtcagaaattttcgctggatgtttcgtttgtcatataaagatttaaatgattgtcccggtattaatatcgataaatactgttcgcccgttgccaagttgacgccgatgcttgagcagacagttgctgcaacaagacggccttttgagcggatgcctttcatgacgccttccaatagtgcagaaatcaatccgattttctccatcaatccgccgagtgcaaaagcaatcataatgagagagacagagcccatcatggattgcagtccgcctctgttaataattttagcggctgcctcattgtcagtttcgaaagttgtgccattttgtaaagctgtcataaacgcctgcaggctgctgtcgggtacaaaaatagcagtcaaaattcccgaggaaataattccggcagtcagaacggggattactgatacccgttttattgccagcaaaacgactaagagcggagaaagaagggcccacggtgtcacgtttgcggcatcttttattccggttatgacctgctgaatattctcggttgaagcagcgtccgctgacactgatgaaccgagaaagtaaaacagaacgacagtgatgagcaaagctggaatggttgtgcccatcatatggcgaatgtgttcaaagatcggtatttcgcctattccggctgcaaagttggttgtgtccgacatcggcgacattttatccccaaaacaagcgccgcatatgactgcgcctgctgtccattcaagcggaacgctagccgcgctcgccacgccgatcagcgctactccgattgtgcttacagttgtcaggcttgagccaacaagtgtgctgatgatcatacatgaaaacaaagcagtcaacagaaggtggcttggttcaataaaggatagggcataaactgtcacagtcggtattgcgccgctgtacatccaggcgccgattaagatgccgatcagcgctagaacaataatcggctgtacgccgtttttgatcccgtctacaatccctttttcaatactcttccaggaaaatccaaaccataaagctgctgctgaaagcatgacaacacttaaaaacagcgggatatgaggttctacatgaagcaagaataagcaagaaataataatgcataacatcaatataaataaaccgacggctaacggaaacgtcagctttttttgagaatccaaaataacaccccatatttatctttaatgcttttgtgcttttgggcacgaaagcattataacagaaaaaaacgaaaatctatgttttttcacaattatgaatataaaagaagtgagcacagggcgtgctcactttacaatcaggacgggtatatccgatttcgctgaaagcttttcacttacacttccgaatattagctttttcagcctgttttggtctctgcttccggttacgatcatatcggcagaaatgcggtttgcatgctcgataattgattcagccggatcgccttctaatatatcgatatctccatctgcctgctgttcattcagcatcattctggcttcggcgatgacttcttccgtacggtcttcatagatcattggctcaggtgatgttacatccgatatcagcggatcaggaacacttgtcatgcctccgctgatatagcttgcctcagctgcgggtctgggcgggtcgatgacggtctgattgtctttcatatcatgtgaatgggcgacggtaatagcggcatttaaggttttagcaagatcaatggctgcctgaagcgctttcttactattttcacttccgtcaaacgcaacaatgatacggtcagcatggaacatccttctcaccctttcaaagcgtcttacaacactactacccgaatttgagcaccattaaccttttcctattcaagtaatgattgacaataaaaggttttgtttatatgatgataaaaagatgaaatcagaatggaaggagggtttgctatgccaaggaatttgcgtgtttatcaaacagtttcatattggcgcggcaaaccttttgttctgttttcgtgaacggttttttaggtcggaccgcgcgctgaaaagcgctgtgcgtaacatatcggttaaaaaaggcatggagctgacgcttcatgccttttttatatacaaaatctaaggaaagacaggtgtatgggatgtgaagaccaatacagaggtgagggctgttcgtgccaaattggatgaaaaaagctgcaaggaaaaaatagaaggcggctgatgaggagatggggatagatgttttcagttttgaaaaagcttggctggttttttaaggcgtactggctgcgctatacgattgcgattgtccttttattagcagtcaatgtcattgaaatgtttccgcctaagctcttggggaacgccatagatgatatgaaagcaggggcatttactgcggaagggctgctgttttatatcggtatcttttttgtgctgacggcggccgtgtatatcatgtcttatttttggatgcatcagctgtttggcggagcgaatctgatggagaaaattcttcgtacgaagctgatggggcatttgctgactatgtcgccgccgttttatgaaaaaaaccgaacaggcgatttaatggcacgagggacaaatgatcttcaggccgtcagtttaaccacagggtttggcatcttgacgttagttgattctacgatgtttatgatgacgatctttttgacaatggggtttttgatcagctggaagctgacctttgccgccattatcccgcttccagtcatggcgattgcaatcagtctatatggaagtaaaattcatgagcggtttactgaggcccaaaacgcgttcggggcgctgaatgacagagtgctggaatctgtttcaggcgtgcgggtgattcgcgcgtatgttcaggaaacaaacgatgttcgccggtttaatgaaatgaccgctgatgtttatcagaaaaatatgaaagtggcttttattgattcactgtttgagccgacggtgaaactgcttgtcggcgcaagctatctgattgggctcggctacggagcgtttcttgtattccggaacgagctgacgcttggagagttagtgtcctttaacgtttatctcggcatgatgatttggccgatgtttgcaatcggtgaactcattaacgtgatgcagcgcggcaatgcgtcattagaccgggtaaatgaaactctttcttatgaaacggatgtgacagatccaaaacagcccgctgatcttaaagagcctggagatatcgttttcagtcatgtcagctttacatatccaagctcaacaagtgacaatcttcaggatatttcatttacggtgcgaaaagggcagactgtcgggattgcaggtaaaaccgggagcggaaaaacgacaattattaagcagcttttgcgccagtatcctctaggtgaagggagcattacattttcaggtgtaccgattcagcaaatccctcttgaccgtctccgcggatggatcggatatgtgcctcaggatcatttactgttttcacggactgtaaaagaaaatattttatacggaaaacaggatgcaactgataaagaggttcagcaagccattgccgaagcacattttgaaaaagatttgcacatgcttccgtccggtctggagacaatggtcggtgaaaaaggcgtggcactgtcaggcggacagaaacaaagaatttcgattgcgagagcactcatggcgaatccggaaatcttgattctggatgattcactttccgctgtagatgccaaaacagaggctgcaattatcaagaacatcagagaaaaccgcaaaggaaaaacgacatttattttgacgcaccgattatccgcggttgagcacgctgacctgatccttgtgatggacggcggcgtcattgttgagagaggcacgcatcaagaactgctggccaataatgggtggtaccgggaacaatatgaaagacagcagctgttcactgcggaagaagggggagcaggggcatgaaaataggaaaaacgttatggagatacgcacttctttatcgaaaattgctgatcacagccgtccttttgctaactgttgccgtcggtgcagaactgactgggccctttattggcaaaaaaatgatagacgaccatatcctcggcattgagaaaacatggtatgaagctgcggaaaaagataaaaatgccgttcagtttcacggcgtctcatatgtcagagaggaccgattgcaggagcctgtttcaaaagcaaaagaagcgcatatttatcaagtgggaatggcgttctattttgttgatcaggctgtcagcttcgacgggaatagaacggtttctgacgggaagctgacgatcacaaaaggagacaagagccgggcatatgctgccgaaaagctgactaagcaggaacttttccagttctatcagccggaaataaagggaatggtgttactgatctgcctgtatgggggcttgcttgtgttttcggtattctttcaatacggacagcattatctgctgcagatgagcgccaatcggattattcaaaagatgaggcaggacgtgttttcgcacatacagagtatgccgattcgctattttgacaaccttccggccggaaaagtcgttgcgcggattaccaatgatacggaggctatcagggatttatatgtcacagtgctttcaacatttgtgacaagcggaatctatatgttcgggatattcacggctttgtttctgcttgatgtgaagcttgcgtttgtatgtctggcaattgtgccgattatctggctgtggtctgtcatataccggagatatgcgtcatattacaaccaaaaaatccgctcgatcaacagtgacattaacgcaaaaatgaatgagtcaattcaaggcatgaccattattcaggctttccgccatcaaaaggaaacaatgagagaatttgaggaattaaatgaatcacatttttatttccaaaacaggatgctgaatttaaactccttaatgtcccataatttggtcaatgtcatccgcaatcttgcgttcgtctgtctgatctggcattttggcggtgcgagcctgaatgcggccgggactgtttctatcggtgtgctgtacgcgtttgtcgattatttgaaccggttatttcagccgatcacaggcatcgtcaatcagttttcaaagctggagcttgcaagggtctccgccgggcgtgtttttgaactgcttgaagaaaagaatacggaagaaccgggtgaaccagcgaaggagcgcgcgctggggcgggttgaatttcgtgatgtgtcatttgcgtatcaagaaggtgaagaggtattaaagcatatttcctttactgcgcaaaaaggcgaaaccgtagcgctcgtcggccataccggatcaggaaaaagctcgattttgaatctgctgtttcgtttttatgatgcgcaaaaaggtgatgtcttaattgatggaaaaagcatttacaacatgtcaagacaggaactcagatcccatatgggcattgtgcttcaggacccgtacttattctcgggtacaatcggatctaacgtaagtctggatgacgaaagaatgactgaagaagaaataaaaaatgcactgcggcaagtcggtgctgagcctcttcttaagaagcttccgaagggcattaatgagcccgtgattgaaaaaggcagcacgctatcctctggagagcggcagttaatttctttcgctagagctttggcgtttgatcccgcgatcttgattttagatgaggcaacggcgcatattgatacagagacagaggccgtgatccagaaggcgcttgatttcgtcaaacaaggacgcaccaccttcgtcatcgctcaccggctttcaacaatcagaaatgctgatcagattttggttcttgataaaggagaaattgttgagagagggaaccacgaggaactgatggcattagaaggccaatattatcaaatgtatgaactgcaaaagggacagaaacattccattgcataacgctcaaaaacccaaaacaatcgtgttttgggtttttggtttatgtagtcaataagccagtccgacacggtatccgacatactcacctgtaacgagctcacgatataaaaagtccgcagtatcgccgaccgaaatgcttgtgccgccctcaggcaaaacgttacgctccgtacgataaacgccggttgctgttccgtccgggaggtaagtggggcagatgattgtccagtctaatgatgattctttaagcatttcgtatacttttgcatgctccttggctgcgcgggtctgctttcgtttcgattcatttgtttcaaaccggtatttccccggttcatatcgggaatctaggatccctgcggtgccgatcgtaataagccgtttgatatgctgttcctccatagcggagagaatgtgtgccatagcagttgacaaggtatcatcaccatctgtgcctagacagctgatcacgatttcagcattctccattatttttttcacatcttctaagcggcgggcgttccccatgatggttctgtcttttgaaaggggaagatcagcatgttgagatctgatcagagcgaaaatatcaaatctttcatctgctgcagcttgtgttaaaaaggcttgtccgacgcggccgctggctcctaataaagcgattttcatcaaaaaacctcctcgcctttcattataaaaggatgttctcagtttggacagcgcgggaaagaatacctgtacaaataaacagaacgatgggaaacatattcatgaatcatggatacacttacgaattgaaccagctcccaattcacaatggtgatgaatgacaccccgattccctccctttttttctaggatatgtggagcaggaaaaaagggtgacaaaataaagagagcgcggaaaccgcgccctctatagccatatattgaattgttattgaactctgccgcccatttgctgctgagcgaaagatactaaacgttttgtgatttctcctccgacagaaccgttagcgcgagaagttgtgtccgctccaaggttaacgccgaattcagaagcgatttcaagtttcatttgatcgatagcctgagctgcgccaggaactagtaagtcatttgaagagttttggttagccatgtgtaaaatctcctttttatttagtatggttgggttaactggagttgcaccaatctgtgaacccttctcgggtgtcactgccgcctcggcgtaacccaatgctttgccggcttgttactacgtattatgttaaaatggccggaaactcatgcggagaattgtgtggtaaatcttgagaaagcaaaaaaagcttagccgtttaggctaagctagtcataaatatgaaaaagcatcagttcatgtatctcgtttgtaagagcaggctcgtcagcgcgggcgggaaacaagtctccccattcaatctcaccgctcttatgatagatgccttcataatgggtccctttataataaaatgaaattttccatccgggcagcttttcttttgggaacaaaggtttccagctgaaatgagaaatcattacggccacgctccttacatttggtatcaattgacctgaataaaaacggcttatgttcattgtatcattgtttcagaacatcattgaagaggccttaatatgcagattgtcccagctttggataaagataagcccgctttattaaaaaagcggacaggttacgaaggccacaatgcttcaggagatgtgattgccttctcagataaatatgacgcgtattcaaagcttcttcgttttgtaagagaatcaacatgatgcaaatttggatgagaaaaaatgcttcggcctgggcgcgaattcgcttcaaacatccatactttaccgttctgatcaatgccaaaatcgaaaccaatctccccgataaacccctcgatatgatcatgaaggacatggcttgccgtcagtgccgctgcagaaagcttttttatgacctcaactctttcagcgggatcatcgtatacttccgcaagtgtctttacagtgccgccgttagaaagatgtgttgtaatgctgttctttccggaaatttttacggcgattgctgtcactgtccattttccttttctgtttttattggtatggacacggaaatccgctggtttgccgtgaaattcgatgagatcaacaccttgctgaatgagaaagtcggacgtgttgtgctgtttttgaaattctgcaaggaatgaggcggcatcggaataatcaatcgaagtaaatgttttggcgtcattcgtatgctttaccgtcaggccatcatctgttcttgtcagctgataaatgccggtgccgagtgctccatttgctggtttgatatagatttttttgtatgcgccacagagctcatcaatcagctccacagacggtgtcagctcggatctaggcaaaaagggtgccgttcttggatctttttcgagcaattgatgaacgttccatttattgaaaaacgttttattaaaccatgggatctgatattcatcgatcagcctcttttttgtatgttgcaagaggagtgaatcttcaatttttcggttcggcaaacggtcataaacgacgttcggcaatggaacgatttttttctcccagccgttttccctgtaaaggagcccttcaatcgttccttcctcccaattgatttggtgcgcgccaaaaacgaagcagtagcctccggcttgctcgtgtaacgtgactagctttgaaaaaaagagggaacgatccttaaatggacgttcaagagatacagtaaaccctgccgtaaagatgccgactaacggcccgatatgcactgtatgatcatgaatcagtatatcagccctgcttcggtgggggagcaaaagctcatgaaacagattttcagagagcagcacggtttgttccagatgccgtctgtaagcaacgtggcatctgacaaccttcgttccgaatgcggcatgcaaaagtccgtctcgcttcagcgaagagggcagaaacagggtgttttcactggttttgtctatgccgatcaaaaaccgtttaggattcacgcggaagaactcctttctggctttgctcagaaaacagatattggcagcgctttaggggacaagtgtacagctgttctttttgctcgggagagacacgcaggattgacttcctgcctggtttggaattgatatctaaaatccaaattctcccgtccttagcaagacatatatcaagaccgagttcaaacaacggcccgtagcgctcgtcaagataatacggaaccgattgggtaatcgaaaacacatcatctagtaaaaccacttgctgttttttcggtatatcttcaaaccaggagtcaaatgtcagcgcatcagatccgcctgacaaattggccagcagcccgtgtttgtatccgcgtcttactgcctttccgactgtattccattcacctgcttcgtttttttccataaacagacgaatatcacaagggtattgttccttatcttgaatgtttaagtaaggctgaagcaaatattgatgctgaagcacttttttgcaccatgttttaaaagaagtctggttggaaaacgtttttgtctgcttatcctttccgatgtgataagtagcagtgatgtttttcttgcccagcttcaaaagaatcacgcctctgcctcccgcgccgaatgccggtttaaggatgcaggctttttctttggataaaaaggattgaatttgttcgtagcggttcacctttatcgtttcgggaatatagggattgattacagagtgctgctgcaaatcgtgaaggacggtccacttatcgggaagaccccgcccgatgaattccgttttcggatattttttgagccactcaacgattggttttgctttttgggaatgtgaatccttgccgtaaaaacagcgatcataaatataatctggaatcgccatttcagtttcgttccatgtggccgaatgatagaccgatgctttgacacgcaaagtgtcaggtaaaatatcaaatggtgtaaaccggatgaaacgtatgccgaattcgggtgctcttttggccagttctgcggaataatccgcttcatgctggcgggataaggacataaaaccgagtgttatcatggtgagactcccccttttattcaaaagctgccggcgggtgtccgcagctttacactaaatacatgtaagacgaacgcagctgacggtattctactttacagaatacgattcttcaccttgccctattccaaaagaacaagctgattttctaagaacaggaatttgtctcctcgtttgctaagtgattgcatgagcctctataatacgtataggtacataatctatatgaaaaaagctgaagcacagatggaggaagatgaataggaatgggtattgcaggaacctttatttttatgatcgtgatcggcgctgccattggagcggtgaccaatcatttagcaattcaaatgctgtttaggccgtataaagcgtactatttgtttgggaagcgagttccttttacgcccgggctgattccaagacggcgagatgaacttgcaaaacaaatgggactgatggtagtcaatcatctcttaacccctgaaggcattaaaaagcggctcgtctctgatgcagccaaaacgcaggctcttcgagtgggggaacagctgattcaaaagctgtcactttctgaagtgacagtaaaagaagcgcttgaaaaagccgggatgaagcgccccgaaaaagctgctgatgcatggatcagcagctggaccgatgataagctgaatgagcttttccgccaatacggggaccaatcgttaaaagagctggtgcctatagaggtgcaggaaaagcttgaggaaaaaattccgatgatttcaggatatatattgtcacggagtgtccgttattttgaaagtgatgaaggaaaaatccgtcttggcaatatgattgatgactttttaaaagagcgcggcatgcttggaagcatggtgcaaatgtttcttggcaattcaagccttgcggatcgcgtgctgccggagctgctgaaattcttgcggaatgaggaaacaaataaattgctttctgatctcttaaaaaacgaatggggcaagctgagggagtatacgtttaatgaagcagacgaaaaatggaatgcaaaggcgctcattttcagtttgaaacgaagaatgctgcaagcattttcgactgcccctttcttcaacaatacgattggcacgcttaccgtccgctatgaatctgagctgacccagcaaatgctgccggcactgttagacaaattgcttgaagggatttcgtccaaccttgaaagtgtcttaaaacggttgcgtcttgaggaaatcgtcaaggagcaggtggatcagttcccggtggagcgtcttgaagaaatggtgctgtccatttcaaaaaaagaatttaaaatgattacctatttgggggggcttctcggcggaattataggcgcgattcaagcactgtttgtcatccttttttaagaagaaatgggttttgattaatgaaaggatctccatagtctgttatagtggagtggtatgtcaaacggcaatgatgaaaggagctatttacaatggctgttaatttttatgatgtagcgtatgatctggaaaatgcattacgcgggagcgaagagttcacccgtttaaaaaacctttacgacgaagttaacgcagatgaatcagcgaagcgcatgttcgaaaacttccgtgatgtacagcttagactccagcaaaaacaaatggcaggagaagagattacacaagaagaagtgacgcaggctcaaaaaacagttgcgcttgtacagcagcacgaaaaaatttctcagctgatggaagcggagcagcgcatgagcatgctgattggtgaattgaacaaaatcattatgaagcctttagaagagctttacggcagtgttgaaggctaataagcaaaatcccttcttggataagaagggattttttattcattcagcaaacttggaaatccaatgaatcttttacctctccattgatgatgactgataatgtatgaattcctttgtaatgctttctggtggttaaatccttaaaggattggattcttgtgtatgacttcgtttcgttttttcgtatatttgtttctgttattttaaatactttctgatgacgctggcctcttgcttttacaaaatcaattgcgtactcaattcttactttttgatccctgtctgaatgaatatagaaagaaaattcaaggctttcgccaataactatacgtttgggctggcatgttaaatcatgtagttgtatcgaatcagcattttcataaccaaaaagcgctaaggcctgtttatcacccttttttaataaggtccgataggcgtgtttgataatccagtctgtatggggatgtgttccgtaccattgatctgcgacttttctcagtaaatgaggatgcgtttttgatatatcattaaggttgttggccacgcttttccttacatataaggactcgtcctgcatcagcttctcaaggatcggcaatacaggggaagggtccgatttcaaagccggtatcgattttccccatggcaggcggggcctgctgccttcgctcgcaagtcttctcacgtgttcatttttatgctcagaccatgcaagcaattgtgcaatcatcttttcttgatctaacagcaaaaaaggccttacagcaaattctgaggtcgaatattgcgtaaagtattccaatgcctttattgattcttcccaatgcgctaacccgtactgttccacataatctggaaataaaattccgctgagtcctttaaaatgaggggctgtatcccgtaaaattgtgagcgcttcaacgtattgttttggcaaagtttcgtataaagaaactgtcacgcggcgcatccgctcttttaaagtgagttcaggccagtcctccagccgtaatgtacccaagaatctgtttttgttaaaatcaggataggatgaccttacatgatggatcaactgagatatcagttcttcattatatatttcttttaaatcagccatataaacaccgctttttcgtttattatttatattgtatgggaatgtacgttctggatcaagtgtatagtcctaaaaattaacaactgatcctaccacggatatacaaaagttggttactttttttagttaaaaaaacccttgtcatcggaaaggaaaactgagataatgacattgaaagcgcctacacttacctatttcaaatggatacggtcgcatatcatgccgttatatagaggggataagcaacagagagtaagtgttcggagcgcatcattggtcaaacaaggggttcctgatacatgatttttcgtaaatcgaaataacgatattagggagaatggctgcttcgatcgtatcctatcaacaagccatacataaagtctgctgagccaggctttttttgctttaagaaaaggttgttctaaacacagagacagggtcatatcctatacacaagtacagtcatcaaggagggggacatctctgtgtcaaaacaattgcttgccttaaatatagatggagcgctgcttcggtcgaacgggaagattcatcaggcaacgaaagacgcgattgaatatgtaaagaaaaaagggatttacgtcacacttgtgaccaaccgtcattttcgctcagcacagaaaatagcgaaatcgctaaagcttgatgccaagctgatcacccatagcggggcatatatcgctgagaaaattgacgccccgttttttgaaaaaagaatttctgatgatcatacctttaacattgttcaagtgctggagagctatcaatgtaatattcggcttcttcacgaaaagtattccatcggaaacaagaaaaaggtgaattcgaatttattggggaaagcactcattcatccgtctgacccaatcttttatccagtccagtttgttgaatcattaagcgatctcctcatggatgagccggtgagtgcacccgtcatcgaggtgtacacggagcacgacattcagcatgacattacagaaacgattacaaaagccttccctgcggtggacgtgattcgcgtaaacgatgagaagctgaatatcgtcccgaaaggtgtctcgaaggaagcgggtttggccctcgtcgcttcagagctgggcctgagtatggatgatgtcgtggccattgggcatcagtatgacgatctgccgatgatcgaacttgccggtcttggggtagcgatggggaatgccgttccggaaattaagagaaaggcagattgggttacaaggtccaatgacgagcaaggtgtcgcttatatgatgaaggaatatttccgaatgcagcagcgaaaaggatttcttgataagttccacatgaaacgtgtgtaaaaaagccgctcgcaccctgacaggtgcggcggcttttttgccggattgattttagcagtttatttctgtacactaaagaaagttttgaatctgataaattaggtgatgaagttgcaaattaaaatagaaggcatacatgatgaccgcctgcatcggcctctgcaaaatattgcaaatttgttttatgaagagtgcgagcttgcgtatggcggagaggagcccgcagattttgtcatttctttagcgttgtcacaaacggatgagcatgtgacggtttcgggagaagtgaagggtactggcataaaggaacagcatacaaaattcttttctcccggcatgaatgaaaaagaagcttttaagcaagtgaaaaacacaatttcttatgtgtatctcaatcttcttcaggcgcatacgggcattacgcagaagtggggaatcctcacaggaatccggcccacaaagctgcttcataaaaaactgcaaagcggaatgtccaaggagcaagcgcatgctgagttgaaaaaagactatttaattcatgatgaaaaaatcatgctaatgcaggaaattgttgaccgtcagctggcggcagtgccggatttgtaccgagtaaaggatgaagtcagcatttatatcggcattccgttctgcccgacaaaatgcgcgtattgcacattccctgcgtatgccatccagggacaggcaggcagagtcggctcattcctatggggactgcattacgaaatgcagaagatcggtgaatggctgaaggagcatgatgttaaggttacaaccatttactttggcggcgggacgccgacaagcattacagcggaggagatggatctgctgtatgaagaaatggtccgctccttcccggatgtgaaaaacattcgtgagattacggtggaggccggtcgtcctgatacgattacagaagaaaaactcgccgttttaaacaaatatgacattgatcggatcagcatcaatccgcaatcctatgaaaacgaaacgctaaaggcgatcgggcggcaccatacggttgaagagaccattgagaaatatcatctgtcacgccagcatggcatgaataatatcaacatggacttgattattggtttgcctggggaaggcgtgaaggagttcaggcacagtctttcagaaacagaaaaactgatgccggaatcccttaccgttcatactctttcatttaaacgggcgtcagaaatgacgagaaacaaacataagtacaaagttgccggcagggaagaggtttctcaaatgatggaagacgcggtagcctggacgaaagagcatgggtacgtgccttattatttataccgccagaaaaacattcttggaaaccttgaaaacgtcggatactctttgccgggacaagaaagcatctacaacattatgattatggaagaggtgcagacgattattggcatcggctgcggcgctgctagtaaatttattgatcgggatacagggaaaattacgcattttgcgaatccgaaagatccgaaatcgtacaatgagcgcttcgagcactacacggacgaaaaaatcaaatatttagagcagatttttgaaaaaacgacaaagcagcactgattacagtgctgctttttttatccctgtttttttgcgggctgaacctcaggcttccatttaaataccttgttcagcaagcggtaaattcgttttgattcctttgtgacaagcggtcccaaaatcgccagaatgaggacatataatgcggcaaacggctttaatgtggccgacagtccgccggctattccgagattcgcaacgataatcgaaaattctccccgcgatacgatcgtcagcccgatattcgatgaagccttatgagaaagccctgcgcgtcgtcctgccaccattccggcgataaaatttcccagaatggtcaaaatcactgcacccaacgcaagccaaaccgcttcaccaagcgaaaacggatcgatactgaggccgaagctgaaaaagaacatcgcaccgaagaagtcgcgaaacggaacaacgaggtgttcaatcctatcggaatgctctgtttctgaaaagaccaaaccgagcagcagcgcgccgattgcttctgctacatgaatcgtctcggaaaacccggcgataaaaaagagcgctgcgaaaatgacgataataaacacttcgtttgagcgaatgtccaacagtttgttcaacagcggcgggagttttcttgctgcgataaaaaacagcagcatataaccgaaggcgatcaaaatggacaagagtgcactccctacggatgtcgcatcacctagtataaggccggaaacaacggacagatatacggcaaggaaaatatcttcaaacatgatgatgccgagaatcaattcggtttccggattggcagttctttttaaatcaacgagcacttttgcgacaatcgcacttgacgagattgtgatgacgcctgcgaggatgaggacttccagaaaggaaaatccggtgataaacccgtaaagcagtccgaggctgaagttaatcaaaatataaatcgtcccgccgaccgcgattgattttcctgatttgattaacttcccgacagagaattcgagtccgagatagaagaggaggaacagtacgcccattcgcccgaaaaactcgatgatttcactgctttgaataaatgttagatcaataatccccattttcggcgcgtgcggtccaacaagcatccccagcacaatcagaaacggaataatcgaaaatttaattttattggcgatcacactggcgattgctacaaggacaagtgcagttccgacttcaaatacaagatggtccatcggggctcacacgccctctccagaaagaaaatcgtgaatcagtttcttcagatgctttctctcacctgagaggacaagggtgtcattttcttcaataatcgaatcggctccgggatttaggagcttttcctggttgtgtttgataatggcaatcacagtgacatcgtaattctggcggacatcaagctctccgagtgtgcgcccgatcgatttggcgcctttttcgaccttaaaccattcaataataagatcgctgaaggccatttcgatggactccagagcttgcggtttatagaccatgccccgagaatagctgcaatttgccttgcttcagaatcatccaatgaaatatttgaaagaagctcatccgggtcccggtcattaaaccggtaaatttcccttcttccgtcatcatgaatgataatcgtcattttttcgtggcttcttgtttcgatttcaaactttttgccgatgcccggcagattgttttctttaatattcaatgaaaatccctccgaatgtagtgttggcagtatggggtgagttacaaataaaacttgagcaaattatattcggaggtaattagactggtatttgacagggacggcccaagccttttccagcctgtttatcagcggttcgtcaagtggtttgacagagagctgcctgacagactgtgccagcgggctgtactctttgatcagctcagccgagtgcatgctgcccggcgacggggtttttgccgattgtgtttcctgcggatatgaagtcataggcacatagctgtcagtgcttgcttcaaactgggaaggcagaaccacgtccgaagggggaaagtacaccataaataaacttaacagaaaactgatcagcaatttatccatgttcctttcctcccttctcatcaagatatcccttctttttcactatataaaactttatgtttccattcaaacaatatgcatttttcagtatctattgaccttgaaaaataaaaaggtttatttgaggatggcggggaatgtataggagaaagaaaaaaagtaagcgcatacatggaggtgctttatatggagtttgttcaatatgcatgtaatggggctgttgcagagattatcctgaatcggcctgatgcccatcacgccctgaatgaacagatgctgtctgaattgaaggaggcagtcgaaatggcggctgcaagcgaggcgctcatcgttctcctgagaggaagcgggaaaggcttttcggccggcggtgatatcaagatgatgacatcagagcatgactctgatcaatttaaacggctgatggatacgattgaggctgtcaccctgaatttatatcagatgaagaaagtgacaattgcagccattcatggcgctgctgcgggactgggcctgagtttggcgctttgtgcggacattgtgctcgctgaaaaaaacgccgtcctcgcgatgaattttatcggcattgggcttgttccggacggcggaggacattatttgctgaagaaaagaatcggtgaagcaaaagcgaaaaaactgatttggagcggaaaaaaactatctgcctcagaagctgccgatatggggcttcttgatgggacatttgccggagaccctgccgaaggcgcaagacccattatcgaaaccctgttggcctcccctcttttggcgatgatcgaaacgaaagctatttttcaaagcctccagattgaagaactgaaaaaagtgctatcccttgagcgcagcgcccaagagagaatgagaaggaccaaggatcaccaagaaggaatccgtgcatttttagaaaaacgggagccgaagtttcaagcgtaacagatcagccggaaagctgatcatctgtgaaacaaaatcagctttccggctgcattgactaatcgatgagtatgactatgaagctctttttcttttaagagggcttcaccatgcgtttttgccgcttcttcatgttctgcctcgaattgctcgtttaccagcgtgttccccgaaggatcaaatacggtaaggaaataatcagccatcaggtttctcctccattttaaggtttatcagtctttcttcatttatattctaaaaaggaaatcaaaatcctttattatgctttatccaaaattagtatataatgggtcagggaaggaggagattcagtgcttacaattgatcacgtaacgaaaacatttggagattataaagccgttgacggattggacttagatattccggaacagcaaatgttcggtctgttaggcgcaaatggagcgggaaaaacgacgacgtttcgcatgatcctaggattattaagcattacggagggctcaatcagctggaagggccgtcctgtgaattatcatatcagcaacaaaatcggttatttgccggaagagcggggcctttatccgaaaatgaaggtaaaggatcagcttgtctatctcgccagattaaaagggatggagaagcgggaggctgtaaaagagctcgggacatggcttgaacgcttcaatattacagattacgagaataagaaggtggaagagctttcaaaggggaatcagcaaaaaatccaattcatttcggcagttttgcataagccggagctgcttattcttgatgaacctttcagcggcctggaccctgtcaatgttgagctgctaaaagaggctgtgatctcgctgaaaaacagcggcgtttctattttattttcaagccaccggatggaacatgtggaggagctttgtgagaacctttgcatattgcagaaaggaagaccggtcgtgcaaggcaagctgaaggagatcaagcgctcctttggcaaaaagaacgtcaccattcactccgatgacgatctaagctttttgcagtctcatgaaggcattctacaatggaaggaaacggccgacggcgtcaagctgcagattgccaatgaagacatttctcaagagatttttgcgatgctacagggaaaagggtttatcagaaagtttgagcttgaagagccgtcactgcatgatatttttatagaaaaggtgggggccgtctatgaataaattttggatcatgctttctcatacatacaaaaataagattatggcaaaatcctttattatttcgactgtcatcacggtgctgcttgttttagttgtaacgaatctggagtcgatcatttctttgtttcaaggtgacgatgcgaaagaaaaaatcgccgttgttgatgaaacaaacgaattatatccggttttttcaaagcagctgaaagcggtggatactgacggcgatcttgatgtgaagctgtcgaagcaatcggaggatgaggtcacaaagcaagtcaaagatgaatcactcgatggcatgctcatcatcaaacgagatgaaaaagggaccatttcaggaacatataaagcgttaacgatttctgatgaaagcacgtatcaaacgctgcagcaggcgctgacgcaaacaaaaacagctgtcggaacagcggagctcggcgtgtcgcaggaaacgattagcagcctttatgcgcccgttactgtggggcagaaggcgctgaaagaaggggcaaagtctgaggaagagcttggccagacggtagggcttgtttacattatgctgttcgtcatttatttctcggtgattatgtatgccagcatgattgcgatggaggtcgcaaccgaaaaatcttcgcgagttatggaaatcctgatctcaagtatgccgccgatccagcaaatgtttgcaaagctgcttggtattgggcttgtcgggatcacacagcttgctattattataggagccggctctctgtcgcttaagctgaaccaaaagagcgaaacggcttcatctgtcggcggattccttaatttgaccgacgtatctgcaaccactgtcatctatgctgtcattttctttttgctcggatactttttgtacgcgacacttgccgcgtttcttggcagtgtcgtcagcagaatagaggacgtgcagcaaacgatcacgccgatgacgcttttggttgtcgccggttttatgatcgcgatgttcggtttgaatgcgcctgacgcaggatttattacggtaacttcgtttattccgttctttacgccaatgattatgttcctgcgcgtcggcatgcttgatattccgttctggcaggcggctgtcggaatcggaatcacactgctcaccattgtcatactggccgttatcggcgccagaatttataaaggcggtgtattaatttacggcaattcaagcgcgttcaaagcgattaaacaagcgctacgtttagcgaaaaactgattggaaaacagcctggggattctcaggctgtttcttttttgacagaacgtgcattcgcaagaattcggtgctaaaataagggtacttcatcctggaaaggagcagaatgttgactgatctaacctttattcatgcggcagatcttcatcttgacagcccgttttacgggatatcgcatctgccggagccgatttttgcccggattaaagaaagcacgtttgcaagcgtgagacatatgatagacgccgcagtgagagagcacgttgatttcattttgctggcgggagatctgtttgatgaagccaatcgaagcttaaaggctcagctctttttgaaaaaacagtttgaaagactcagagagtgcgggatttcggtatacgtcatctttgggaatcacgatcatcttggcggggagtggacaccgattgaatggcctgagaatgtccatattttttcgtccgctgttccagaagaaaaatcgttttttaaagaaggcaggcgcatagcaagcatttacggcttcagctatcaagccagagcagtgacggaaaaccaagccgcccgctatcggagatcaactgacgcaccgtttcatatcggcatgctccacggcacgctgtcaggatctgaaggacacgatccgtattgcccgtttacacatgacgacctcgtgaaaagcgggatggattattgggcgcttggccatatacataaacgccaggttctatctgccgagcatccggcagtcatttacccgggaaacacgcaagcacgccatataaaggaggcgggagataaaggctattatctcgttcatgtgacaaacggagatatatcttatgaatttcagagagcgcatgatgtcctgtgggaaaaagcggcggttgatgtgacggaggcaaagaatatgacagccctcttccaaatggtggaggacacgttttcgaagctgcggaaaaaggggagccctgtttgtgtaaggcttgttttacaagggacggcgccggaatggctgctggaggcgccaaaaggcaccttggatgagtttcttgaagctcttcaggaacaagaagcggaagaggaacatttcgtttggcctcttagattggacgatgagacagaaaccgaagcaaacctaacaaaccttgatccttttttggtggtttatttgaagacattgatcgcagcgatctgtcagacgtgctggaagggcttgagcggcatccagtgtatagaaggcacgcggaccggtttagccaagaggaggtaaaggaaataaaagagcaggcacagatattattgaaaagacagcttaaggtgcttgatacatgaggcggtgacagctttgcgaattatatctttacatatctaccaatacggaaaattttccaatcggacctttcacttttccgcctctcctgtccaagtcatctacggattaaatgaggcaggaaaaacgacgatgatgtcattcattgaaagtatgctgttcggttttccgaaaacgaaaaaatatgaaccgaaaacaggcggtgtctacggcggtgttcttgaagctgaacatcctgagtatggggtgctgaagatcgaacggacgaaagggactgccgaaaaactaagcgtgtacacagaaaagggcgaagtaaagcagggagatgttttaaagcagctgttccagggcacagacaggtcgttgtacaaagccatatattcgttcgacgtattcgggctgcaggaaattcacgcctttaatcgggacaagataggggaatttttgctcttttccagcttgtttggtgctgaagccgtatcgaagcttgattcaaggctgacgaaggaaagcgaaaggctctataaaccaaatgggcgaaaccctcaattgaatcaggaactggaaacgcttaagcagctggcagtgaagctaaaacaggctgaagcagaggaagcgggctatcatcagcttctcggggaaaaacgaatgcttgaagcccgccttgcagccgcggaaaccgaattgaaagagacggcgggacatatccgaatgattgagggagcgattgagcgaaaaccattgttaaatgaaaaagcgacactcgaacaggtgattgcagaatttccggaacatgcaggacaatttcctgctgacggactgcatcagctggaaaaatatgaatcccatcttcacccgaaatcagcacagcttgaggcgcttcgggtgaagatggcggagttggacaaacagaggcaaaagcttatccccgataaagaactattggcgaaagaaacgctgatacaagagctttcggcagcgtttcatatgtaccaatcctgtggagaacagctggcagccattcaggcacagctgcgccaggcgtctgcgcagacagcggcagggctggaacagctcaataaaacggatgaaaatgagctcctgaatatgaacacctcatatgattatgaatggcagcttcagcaagcggtgcagcaatatgtacaggcaagagacagaaaacggcagcttgacgagacatttgaacttgcccggcaagagctggaagacacggaaaaggccgttcgtgccgcttcgtccgcgattcttgaagatagccaaagaaaagataaagaagctgctcttagagcatatgatgaaacacaggggcagcaccaagagcaagcgaagctcagagaacagctaacgttttttgaaagacagcaggctaaacagaaaaagactgtcattgcagctggtatgttgttcatcgtactcttttctctgctgcagcaatggattcccgccataagtttcggcgctgcacttattgtgtattggcttgtatcaggaaaatcgtcttctcgaaacagccgagagacaagacagcccatgacggatatttcaccagcagaagctgaaatgcttagagaagcgttatgggaggatgaccgcaataagcagcaccttctcacacagcgtgcagcgctccagcaaaaggaggcggcgtatgaaagggtcatccagcagtttgaacagtgggaagccgaaatggcgccgtcctttacacaggttgagcgttttatgaatgagctcggatttaaggaagatccatcatttttgcttgatgcatacagcttaatgaaggatgttaaaaaagaagtgaagaaaaagcatgagctgaccattgaagcaggcaggctgaaaaagcaccggagaacattcgaagaacgcgtcagtatgcttcttcccgtgaatcagagtcaggatatctccatttcggacgcccttcacacattgcggaaaaacattgaacgtgaaaaagaaattgagaagcaaaaaaaggaaattgaaacagatattcattatacaaaggaagagatgcttgaacttgagcaagaaatacagtatttccacgcacagattgaacagttatttgccgcggctgctgcaaaagacagagatgcgttttttgccatagccgacatcagcaggcaattgaaggatacggagaacaagcttcatcacgtaaacgcacagcttcaaggcgggtacccggaggaacttgaactggcggattccaatacgctttctgaattgaaagataagcaatttgttgagaatgaaagaaaagagcggctgactgaggagatcgagcagctccgcagccaaatcgcactgctctcagtcaaacaggaacaattagaggcttcgggattggtctcagacctcaagcttcaaaccgaaatgcaaaaagaacgtgtaaaagaaacggctaaaaaatgggcctcgatacaaatggtcaaacaggtgatcagaaacaaattggagcggcataaaaaaatcgagcttccgcgccttctagagtcggcaggagaattcttccgccctctgactgacggaaactaccaaaccatttatttttccgaaacggatgattcgatcatggttatgcatcgcgatggaactgtctatcatgcggaagagctgtcacaagggacgtgtgaacagctgtatacagcgatccgatttgctttggccgttacgcgccagggtgggtcaaagcttccgttccagcttgacgacagttttgttcattttgatcaggaaaggctgaaacgtgtattacatgttctgtatgatttatctgaaggcggtaggcagattttgtattttacatgccatgagcacgtaaaagatgcatttcatagcagccaaatcatccatttggtctcataaaagaggttctatagctgaaaatcggtatgtgatatactggtattatgtaagatacggagggagctttaatagaatggctaaagggattatgctacatgaggttggcgaacaggtggaccagtatctattgattaaatcctcgacgaaagggattgcaagcaatggaaaaccgtttttgacgctgatgctgcaagaccagtcaggcgatattgaagcgaagctgtgggatgccaagcaaagtgatgaagtgacctatgcgccgcagacgattgtcaaggtcgtcggcgatgttcatcattatcgcggacgcacccagctgaagctaagaaatatcagaccggtaagcgagcaagaaaacgtcaatattgatgattttttagaaaccgcgccgattccaaaaaatgaaatgatggataccatcactcaatatatatttgaaatgaaaaatccgaatatccagcgaatcacaaggtttttggttaaaaaacacgaagctgagtttatggattatccggcggctacgaaaaaccaccatgagtttgtctcaggtttggcgtatcatgttgtctctatgctgaacctggcgaaggcaatagcagatttatatccttctcttgatcgtgatctgctttacgccggtgttatcctgcatgatcttggaaaagtgaaggagctgtccggccctgtttccacttcatatacggttgaaggcaatttgctcggccatatttccatcatggtgacagagctttcaaaagcggctgaggagcttcaaatcgattctgaagaggtgttaattcttcagcatttgattttgagtcaccacggcaaagcagaatggggcagcccgaaaccgccgatggtgaaagaagcggaaattcttcactatatagacaatctggatgcaaaaatgaatatgatggacagagcgcttgagcgcgtgaagcctggcgagtatactgaacgtgtattcgcactggaaaaccgttccttttataaaccgacatttcataaataacgtaaaaaggactgatgctgacatattcagctcagtcctttttgatgcgtctttcccgcacataactcgtctcattcccgcatatggttaagaataaagaatctatgcaaagggggaggagcccgtgttattttttccgtggtgggtgtatctttgtattgtaggcattattttcagcgcatataaacttgtggcggcagccaaagaggaagaaaaagtagaccaggcttttattgaaaaagaaggacagatttatatggagaggatggaaaaggagcgagaacgccgcagttctcagcagcatgaagaagaaaatcaaaaccattccatcgcataaaaaaagctgtgcggctcaatgagccgcacagcttttttattatttagaactgcttgaagacgaagaagtgctgttgcttgttgaagatgtattaaatgtgtctttcagatctttatcttttacttcgatgtcagctttcttcatgactttttgaacagcttcctgaacagctgcgttgtcatttaatttttgttcaagcacttcagatttcagttcttttttcatatcatcgtatttgccgcgttcttctgtctttttaatgatatggtagccgtattgcgttttgacagggtcactgacttcacctgtttttaatttgaatgcagctttgctgaatgtttcgtccatttggccttcttttgcgaaccagccaagatccccgccttttgaagcagagctgtctgttgagtattctttcgcaaggtcttcaaacttctcgccttttttcagctttttctctacttcttcagctgtctttttatcagcaacaaggatgtggcttgcacggattttgccttttaagccttcccagtactctttgatatcggcgtctgttactttgatgttatctttagccgctttttgtgtcagcaattcatattttacttgttctttcaggtaatctttgccatattgcttttcgagggcagtatattgatcgccaagctgcgttttgtattctttcagcttgttgtcaatttctttatccgaaactttatacttcttgtccaatactttttcttgcactagctgtgtcagtacgcttgcgccagctgttttcttcatgtttgtgtaaagctcgccttttgtgacatcgcctgcgtcagtttttgcgatgacttctttgtcgccgctgctgcatgcactgagagcgaggatgcttgtagcagtgatagctgctattgcgattttcttcattgttttcaaacactcctaatcattccaaattaaattacctatgcgtatcataacatattgtggctttctgtaaaaagattttaaataaagggcattcgtctagtcaaacttttgctgatgacatacttatatattgatcaagaaaaggaggtatgtaacatgagcggaggatactctaacggattcgcgttgctcgtagtactgttcattttgcttatcatcgtaggtgcagcttacatctactaagcagaccgaggatcgcttgcaacataagcgatcctttattttcactagcgcctaatcgtttcaaacatgaattgcataacatgtaattggtaaataaagcttattacaggaggtgctttttaagatgggtgaagtatttgcaggcggattcgctttattggttgtgttatttattttattgattatcatcggcgcttcttggctgtactaatcaacataaaaaagcatagctgcttaatcagcagctatgctttctttcgtatttacactgtaaaggagatctccacaaacgaagagatcagtaaaattaatatagatacattaataaatcggaataccttatcttgccgctcttcaggaatctctctgacaaggcataatgtattggtgagcctgtttatgaaatataaaataaacacggcagccacgataaaatagaataaaatgatgggagattccccctctctctgaactgtcccatattacattaccaaatatttattaaaaaagatagaatgcaaattgaaaaatcgccaccagcaccagggtttgactacttttcaacaagaatatccaagccgtcagcttcctgatcaataaaagcggttttcggtgcttttatcagcttgagagccagcaggaaatcaggcagacagtagccggcgtgaatgcccgagatcatgcaaaaataatgagcgtgattcggaaatgccagtgctgcgtaaaacaataccggtgtaatcagcaagaacgggctgacgagtgaaatcagcattgttgtttttggtatacgtttccatgtgcgcatgcgcaatatgtaaaactttttttctatttttctttttttgcagatgattggcaggacatggatgactttatgtacaaataaaataacgacgagcaaaccgccgaataaagatacatattcatcgcttaagcttgtgccaggccgcagcagctcaaaagctaaaaaggtagatataaaaaccaaaatcataaaacatacagcagttaatattatgcgaacggcgccataatccttcatgagatttatggtcttccagcaattcatcaaagtcatccttccatacatcttgaatagaatctcaaaataatttactcctcccaagagaaaaaatcaatgcttttttaagaaaaaatatcatccggcaggtatttttttgaaacaagcaaacaaactgcgaaatatggggttagaactttcttctcagtgaattatcagctaaaataagattaaagatagaaagaagtggtgtggatggattcgatggatcatcgcattgagcgattagaatattacatacaattattagtgaaaacagtagatatggacaggtaccccttctatgcgcttctcattgacaaagggctgagcaaggaagaaggggaagcggttatgaggatatgcgatgaattgtcggaagagctggcaacacaaaaagcgcaaggatttgtaacctttgataagctccttgcgctttttgccggacagctgaatgaaaaattagatgttcatgaaacgatttttgccctgtatgagcaggggctttatcaagagctgatggaagtctttatcgacatcatgaagcattttgattaactgtttacaggttcgagctcttcagccggttcatccgccgcactgtcctttgcttttttcttcaattttccgtttacgctttcaaagtcattgtcaatattggtgagtgacgtttcgaaaatttccataaaatcatcgccgtagatatggcgtatcatacacatcatttctgccacttcaggaaattttccgaataaatgatacaaaggctgtgaccctttaaaaacagcgttgcgtgtcggatcaaattcctcaagcaagctccagaatacctcggtaccttcctcagtcaattggacatatgtgttccttttatcattcagccgtttggagaaccttaaataaccccgttcttccagcttttttgaaaagttgaatgcggttgatacgtgcatgaccccgaacttcgcgatttcagaaatggaagctccattcaattgatacgcaatccataaaatatgatgctcattaatattcaggtcatacggtttgagccattgctgccaatccttctcgattgatttccaaagcgccttgctaagctgagccattttctgggtgaagaccagagcttctttcacatcatagggcggttccactcgattcattacgtcacctgcttctctttttctttttctctattatgccaataaaataaagattaataaagatgaaaatgtaagaattttttaataaattcacaaaccattgcggcggaagggtttttcggccaaaaaaaatacgggtccaattttggcccgcatttttttcttttgaataggatattagttttgtaaggttttctccagctgtctgattttctcttcgatatcggcaatttctttttgcaaatcctgctggtgaggcttgatctcttcctgccattttttaattgacgtttggagctcgccgcccacgtctttaataacatccgtgctttcttttgccgctttgatcagctggtcttttaatgcaagcccgtctgactttaagcgtttgattgtttcttcaaaagaatcataattggttttcattttttcacgcagctgctttcctgaggaaggtgcagtaagaagaaccgctgctcctccgatgatgccgcctacgaatagtcctgttaatagagaacgtccgctcgccattacaatcaccccgtctttttcttcaaataggattcattcagcatttttcatttttgttgaaagcctgaacttctatacatagcttgctttattttagcatattttttaagtgaaaaggagggagaaggttgtctgtctttttgattgtgttatcctgcatcacccttgccttcgcttcaggcgctgtttactatatcagacttctcagccaggctgcttcttatccgcccaagaaagtcatccggcagaaagcgcttgtttgttcaaccggaaccgcctttacactatgtcttatctttttcacaaaactcctcgcttaaaacatgctgacatgctgcgagcgctctgttcaaaaaaacctctcccggaagcggaagaggttttgtgtgacaattatttagcagcttccataaagcttgaacgtcttaaaatggtttgcacaatcggataaataatgatcattgagattgtattcagcacagcggccggcagaacaacagccgcgaacaatgcggcgaaaccgcccggcaaaccgacgatcaataaagctgacgatagaaacacaattcctgataagatggtcccgatcactgtcagcacagcggctgcacctgttttttggctctttctgaacaaaagaaacagggagaagaacagaaacgctgataccggtttatcaatgatgttagggatctgtccagctggaaacgcggttgtaagcgcagaaatgattccggtcacgatcccgatgacgagtacattttgcactcgcgggaacagcagaatgcccatgaacatcatgatcagcatcatatctggtttcatgccgcctaaaaagggcggaataatggaatgaagcgctgcgccgattgcggcaaacagagccataatgactaactcttttgttttcataactatgctctcctctgctaagctttttgccctccaataatatgctcatcatttattgcgaaggctttacagaatgtgttatgcaaacagtataccaaacggacggtttgcatagccagactttttactcattttcctgctggaatttcttcatgaacgcagctaatttttcacagtcttcgagagagaccgcgttataaatagaagcgcggcagcctcccaccgaacggtgtccgccaaggccgatcatcttcgcatcttttgctttctggacgaatgttttcgttaattcgtcatcccgaagcgtgaaggtgacattcatgcgtgagcggctgtcctttctggcatgtcctttatagaagccgttgctttcatcaatacagctgtagagaacctgcgctttttgttcattgcgctgttcaacagcttccacaccgccgttttccttgagccattccagaacgaggctcagcatataaatcgcaaatgtcggcggagtgttgtagagtgaatccgctttgacatgtgtggaatatttcaggatttttgggacgttcgcattttcatttttcagccagttttttttcatgatgactacagtcacgccggaagggccgaggttcttttgggcgcctccgtagatcacatcaaatttggacacatcgatttttctgcttaaaatatcgctggacatgtcggctacgagcggaattggagaattcggaaactcctgccactgagtgccgaaaattgtattgttggatgtgatatgtaaatatgcgccgtcttttacatccgtaaggtcaacctcaggaatatagctgtaattgtctgtttcacttgtagcggtgatagacgtgttcccgaacaatttcgtttctgccagtgctttttcagaccaagcgcctgtcatgacaaaatgtgcggttttttcaggtgttaaaaagttcattggaagcattgagaattgaaggcttgccccgccttgaagaaacaagatatcgtaatcttccggaatgcccatcagttcgattaagaggcttttcgctttttggtgcaccgcttcatactctttgctgcggtgggaaagctccataacagacatgccggattcgttaaaatcaataaattctttctgtgctttttgcagaacttccagtggcagcgctgcaggacctgcgttaaaattcgttgtacgttccattatgatctctccctgttttccacgttaatgtataaaataatacaattatcctatcacaaaaattcagttttttgataaaaaattagaattatcaaaagaaattgacggatgtttgcgaaatgttcacaaaataaaataacctcatcttatgatgaggccaggcgttttgcgatagaggaagagatgttctgcagatcctccggtttataatcatcagcatgcgttttccaaaccgctccgaatccatctccttttccgtagcgagggataatatgcatatggtagtggaacacagattgtccagctttttcgccgttattgttcagcgtatttaagccgatcggttcaaattcatcccggatagcgcgggcgattttcggaacagcatggaaatattgttttgctaattcatctgtaaattcatatacattctcaatatgtgttttcggaatgacaagcgtatggccttttgtcacttggctgatatcaagaaaggcaagtacatgttcatcttcatacaccttcgcggatggaatgtcgccggcaataattttacaaaagatacaattctctgcacaatgcatgagggttcctccttatgaaattgtttagtatgtatacattcatcgtaccacagaaatgcagaaaatagaaaacaggatgaacggcgagcgttcaccctgaatgcagaggaagagcttatatgaagaaaatgtgttatgcctttggtaagcacctcatttgtcaataaaatgaagacttgtttaatgcctaacgattcctgcgataaacacctcatttgacaatttgcttcatacatgaagaattcatcaattcagtgaagagaaatggtttgagcattggacatgtttattttctatccaactgtttctaagacgtctttgacaaacacctcatttttcagttgatatgcttttcctctacaactattatgatgtccagaaccctgtctctttatgacagcaaattcatcatttgttaaaagggaattgtttcaaatcaggccttgtttttggtactatgaagaaaaacactataaggggagaaactatgtctctgctatcggtaaaagacttaaccggcggatatacaaggaatccggttttaaaaaacgtatcattcacccttgaaccgaatcaaattgtcggcttaatcgggctgaatggtgctggtaaaagtacaacaatcagacatatcatcgggctgatggacccgcataaaggttcaatcgaattaaacggtaaaacgtttgctgaggatccggaaggctaccgttcacaatttacctatatacctgaaacacctgttttatacgaagaattgacgctgatggagcatcttgaactaacagccatggcatatggactgtcaaaagaaacgatggagaaaaggctgcctccgcttttaaaggaattccgaatggaaaagaggctgaagtggttcccggcccatttttctaaaggaatgaagcagaaggttatgattatgtgcgcctttttggcagagcctgcgctctacattattgatgagccttttctagggcttgatccgcttgccattaacgcgctgcttgaacggatgaatgaagcgaaaaaaggcggggcaagcgtgctgatgtcaacgcacattttggcaacggcagaacgctattgcgattcgtttattattttacataacggcgaggtgcgggcgcgcggcacgctgtcagagctcagagagcagtttggaatgaaggacgcggcgctggacgatttgtatcttgagcttacaaaggaagacgctggccatgaataatatgcttgatatttggcagtcgcggctgcaggagcatatcaaagaaacaagaacatacatgaaatatatgctcaatgatcacctcgtcattgttttgattttttttctagcgggcgctgcaagctggtacagcaaatggatacgggacattcccgctcactttccatccttttgggtgatggccgtgctgttttcgctcgtgttgacaagctcttatgtgcgaacgcttttgaaggaggctgaccttgttttcttattgcctcttgaagcaaaaatggagccttacttgaagcaggcgtttgtctacagctatgtgtctcagctgtttccgcttattgcgctgagcatcgttgcgatgccgctttatttcgcagtcacaccgggggcttcgctcgtatcgtatgccgcggtctttgtccaactgttgctgctgaaagcgtggaatcaggtaatggaatggcgaacgactttccaaaacgaccgcagcatgaaacggatggacgtcatcattcgctttgcggcgaatacactcgttctttattttgttttccaatctgtttatatgtatgcgcttctcgtctatgtcattatggctgttctttatctgtatatgtcttccgcagcaaaacggaaaacatttaaatgggagagccatattgagtccgaattgagacgaaagcagcgtttctatcggattgccaacctgtttactgatgtgccgcatttgcgaaagcaagccaaacgcagagcttatctcgactttttgctgcggcttgtgccgtttgaacagcgcaaaacatttgcctatatgttcacccgcgcctttttgcgttcgagtgattatttgggcattcttgtcagattaacgatcgttttcgcgctgatcattatgtatgtctcagctagcccgctgattgcagcggttttgactgtgtttgccattttcattacgggcattcagcttctgccgctcttcggccactttgaccatctggcgcttcaagagctgtaccctgtgcaaaaagaaacaaagctgaaaagctatttctctctattaaaaactgcacttagtattcaagcgctgctaatgtctgttgcatctgcctatgcagccggcttgaccggttttctgtacgcgctgatcggttctgccgttctgatttttgttgttttgcctgcttatatgacaaccaggctgaaaaagcacggaaagctgtgaactgaaaagaggtaatcaaatgacagataatcagctgctgatgcaggaagctttggaatggaaaatgcattttttgcgaaaggattccatgtttgaacgctattcgaagcgtgtccagacgaaggtgaatgaacggattcctgaaaaaatccatacggtcgtcaccgagagtgtgaaaaaaatggtagaagcgacaatggccggctctaatatcatcacctataaaaaggatacaagtgcactgtcgctcagtgaaaaaaacgaattggcgaaaaaaacgattgtttcttatcagaaagtggcagttgctgagggagtcggcaccggagcgggcggcatttttttaggcattgctgattttccgctgctgctttcaattaagatgaagtgtttatttaccttgtcttccatttacggctttgatgtcaaggatgcacaagaaagaatgtttttgctgctcgtgtttcagcttgcgttttcgagtgatgatggccgtaaatcgcttttttctgtcatcgaaaattgggagacggagaaaaagagcatcgactggagagtgttccagcaggaatatcgcgattatatcgacgtcgtgaagctttttcagcttttgccgggcgtaggagcggcagtcggcggaattgccaattataagctgcttgctcagcttggagaaacggcaagacatgtttttcatctgaggatattaaaggaaacagccggagaataaacactccggctgtttttttatagctgatgataggtgatcgcagcgccggcaaggaccttggccgctgtcagcatggctttttcgttgatatcaaatttcggatggtggtgggaataaactcgatctggctgttcgggagctgcacctgtaaagaaaaaagtgcctttcacgttttgtaagaaataagcaaaatcctcgccgcccatttgcggttcaccgtcaatgacctgctgaacgccctcggtattctttgcggtgctcaccaagtggctcgtttcggcaggatggttcacaaccgccggataaccctgttcataggtgtactcataggacgcgtcgtgcatgctgcatattccttttacaacggcttcaatttctttctccagaatgtcccggacattttcatcaaaagaacgcgctgtgccgatgagtactgcttggtctgcgatgacattaaacggattgtcggcgatgaaggagcctgtcgaaatgacggcggattgaatcggattgactttgcggctgacaatgtgctgcaaagaggaaacgatttgcgaaccgatcaggacggcgtctttagtatcatgcggatgagcgccgtggccgccctttccgaagactttaatcgtaaatcggtctgccgccgccattacggcgccggggcggcagagaatagttccgagcggctcagttgcccaaagatgagtgccgaatatcacatccgtgttttctagacagccgtcatcgatcattggctttgcgcctcccggataatattcttctgcatgctggtggatcatcacaaatgttcccttcagttcatgtctgttttggtgaaggaccttggccactgcgagaagagctgcggtgtggccgtcgtggccgcatgcatgcatgacaccaggcactttggaggcgtaagggacatctttttcatcttgaatggggagagcgtcaaagtcggccctcaaagcgactgtagggccgggttcgcttccttctatatatgctaaaacccctctgccgccaacgtttgtgcggattgggactcctaacgattcataataggaagcaataaatgcggcggttttttcttcttgaaatgaaagctcaggatacatatgaaaatggcgcctgatctcaaccatttcttcaaaacagctgtcgagctgtttgtttatctctttctgcagtgtggatatggacaaagccgcttcccccttttctatgttttccatgattgtatagaaaaagtctgaatatttcaactcatgctgttttaaagcatcatcacagctgcgagggttgtcaccaaaaggccaatcgcgacgggaatgaagttttttctggcaagctcaaaaggatcaactttgcaaatggccgcggcgggaatcaacgcccatgggaccagtgttcctccgcccacccagatggcagagatttgtccgagcgcggtcagaacggcgggatcggcatggagagcggacgaaaagagctttgcgatggagccggcgagagaaatgccagaaaatcctgagccgtcaaggcctgttatggctccagcggcagttaatgcagcggcggcaagctcctttgacataggcatcatatgggataaagcaatgccaagatcgttgacaatgccgtgggaacctttagggagtgaagtgcccagtatgctctcatagcctgagtcgccaagataaaagaaagcggcaatcgggatgacggggccgaaaaccttaaaaccgaacttaaatccgtcaataaaatagccggtgattttttcaagccctttatgcttatacacgaaaaaatgaacggtaaggaggatacagattgcagacccgccaattaacgcggtggcatcatttccttgtaggttaaacaagagcatgcaggcgatatctgcaagaaaggcaagcggaatcaaaaaagccagtatggaccgcaggcgttttggcaagtacagcgagttgtcttgttcgccggaaagaacgggggaaaaagaagcgggatgctcctgttttttgcgttcgcgctgaatcatgataaaggcagcggttgttgttgtcgcacccataatcagcacaagcggaatgctggccgagacgacatcaccgactggaatgcctgctgcatccgcagtcagctttggcgccgcctgaatgacaaagtctcctgacagggcaaaaccgtgtccgaataagttcatggccatggccgcggcaagaggcgtcaaaccggcacgtgcggctgcgggaagcaggacggcgccgattaaagcgacacccggagaaggccagaagaagagagaaatggcgaacatcaggcccccaatcagccaataggcagtcacaggccctctcacaaggcttgcaaagggagaaatcatcgcttcatttatccctgtttttgttaacaaatcactcattgaaacgataaagcaaatgatgaaaatcgtgggcagcagttcgccggccgcatagataaagctgtggaataaactgctgacagaagctgaaagtgaatggctggcccatagcgatatgataaaaatgccgaatagagaaataaatgtcgtgtcttttctcagcagcataaataggataattgcaccgataaaaaacacatacagaacatggacagacaaaatcccgacttccatcatcgatcactccttccgcttacagattattcataggcgggcggaaggtgccgggacagaggggagggttatgatggaagatgaacattgatctgtttcagctgccaatcagatgatgccttaatactctattcgctttttgcagatgttttgggaagcattcaggagaaaaaatgacgcacccttcagcaagccagttttttctataggcgatgctgctttccgatggctctaaatatgaatcatcctcgtgctgcatctcgtaatcatcaaatccgaactgaaaaccgcagcacgggcagatttcatgagaatgattgccttcatgatcatatggcggttcagccaatcccttaaacccgcagactgggcaagtatgcttcattttgctttcctcccaataaaataagctgccggacatgccggcagctattcgacagcgaaatatgtggtgacataggaaggccgggagaagatcgacgttgtgtcaattccggcagatgtatcgcgttttttgtgggcttctttgtaagaaccggactgctgccagtcttgaaaggcgctttccgtttcccacaaggtcagaatgacataggtgtcactgtcaagcggacggagcactcgaattgcttcaaagccaggctcgttttcgacttttcccgctctgtttttaaatctgttttcaaacagcggacgcccttcctgagtaacggcaatattgttcaatactgcaaaaccgggatgtttgatctctccgacttggtcaatgacttcataagcgtgtggtgcctggaaaacggtatctccgtttgtttcatgaattaaaatggcgttttcctgcccctgcatcaaaaggatattttctgagggatgcttctgtacgatcgtttttaaaaaatcggctgtcccatatgtaatataaaccttcatatcagccacctcctgcttgctagtatatcaaaacaatggtataagtttctattggcgagtgcttcgaacataattccaaacaatttttcccatactacctttagaaaggcgaggtgagttcatgtttaagataaagaaaaagaaactttttatacctatcattattttagtgttaactgcttttctcgctttaataggatatatttcaattatttttctcggccattatgtcatagatgaaaaaaagcttattcttcatgcttcttcaaaaattgttgatcaaaacggagatgaggttgcaagcctgtatacagaaaatcgcgagccggtctcgatcaatgagattcctaagcaggtcagagaagcgtttatcgctgttgaggataaaaggttctatgagcatcacggcattgatgcaaaatccgtcggaagggcagtgtatcgcgatatattagcaggcggaaaggtggaaggcggaagcacgatcacccagcagcttgccaaaaatatttttctgacacatgacaaaacatttctaagaaaaacaaaagaagtgatcattgcgattaatcttgaacgggattacagcaaggacaagctgcttgaaatgtatttaaaccagctttacttcggacacggggtttacggcatacaagcggcgtcccactattattttaataaagaagtaaaagatttgactgtatctgaaggcgctgttttggccgctattccgaaggcgccttctacgtactctccgattttgcaccctgataaaaataaggagcggcgtgatacaattctaggcatgatgaatgaccaaggctatatcagtgcgaaagaggctgtcaccgcgcaaggccgaacgcttggactgcatgtgaagaaacagtcggaaacaccttggtttgacagctacattgaccttgtgatcaaagaggcggaagacaagtattccatttctggggagcagcttcttcaaggaggatacacgatcaaggtgccgctcgattcgaagctgcagaaaacggcttaccaggtgatgaaagagggtagctattatcccggaacagatcagaatgccgagggaagcgcggtctttattaataacaagacaggcggtgtagaagcggccatcggcggaagggattacacatccaaaggatataaccgtgtcacagctgtccgccagccgggttccacatttaagccgcttgctgtatacggaccggcgatgcaggaaaagaaatttaagccatattctctattgaaggatgagttgcagtcctacggagattatacgccgaaaaactacgacagccggtatgagggcgaagtcactatgtctgacgccattacgtacagcaaaaacgcgccggctgtctggacgctgaatgagatcggcgtcgaaacaggaaaatcttatttgaaagcaaacggcattgatatccctgatgaaggacttgctctcgctctaggcggcttggaaaaaggcgtttcgccgctccagcttgccggcgcgtttcatacatttgccgcgaatggaacgtatacggaacccttctttatctcgagcataatagatgaagacggagaaacaatagccgatcataaagaggaagaaaagcgggttttcagcaagcagacgtcttggaatatgacgagaatgctgcagcaggtagtcaaaaagggaacggccacgtccggcacctatcacggcgacctggcgggaaaaacaggttctacatcttatacaggcgtctccggcgcgacaaaggacgcttggtttgcaggctatacgccgaaaataaccggggcagtctggatgggttatgacaaaacggatcaaaaccattatttgaaagccgggagctcatacccgacgcggctgtttaaggatattttgacacaggcaggagaaaccggtcatgtgttcacaaagcctaaaaacgttaaagaactggaaagcccgattgagctgaagcaggtcaaaacactcacagccgattacacatttaaagcagcggggctctttactattgaattaaagtgggacgctcaagaggatgatcgggccgtatacagaatttatgtaaacaaggacggcaaggagacgcttcttgattcggttgaagggaagggaagctatgaaattccttatgccaacttattttcgggcgcgtcttataaaattgtgccttataatacacagacaaaaagagaaggggaaggaaccgattacgttcagccaaaattgttttcctcttaatggaattcggcgattttttgaactttgagctacatttctataccatttgcctaaaacaaggtatagtggaataagtcaagaaatacgaacgtatggttgccgtatgaaaggtggaaatcagatgagtaaacgagaaacgtttaacgagacgtttttaaaagctgcgcggggagaaaaagcggatcacacgcctgtgtggtatatgaggcaagcagggcgctcacagccggaataccgcaagctgaaggaaaagtacggattgtttgagatcacacatcagcccgaactttgtgcgtatgtcacaagactgccggttgagcaatacggagtcgatgctgcaatcctttataaagatatcatgacgccgctgccgtcaatcggtgtggatgttgaaatcaaaaacgggatcggtcctgtgattgatcagccaatccggtctctggcggacattgaaaaactcggccaaattgatccggaacaggacgtgccgtacgtgcttgagacaattaaactgcttgtcaatgagcagctgaacgtcccgctcatcggtttctcaggtgcgccttttacgcttgcaagctatatgatcgaaggcggcccgtcgaaaaactacaataaaacaaaagccttcatgtacagcatgccagatgcatggaatctgctgatgtccaagcttgccgacatgatcatcgtgtacgtgaaagcgcagattgaggcaggcgcaaaagcgattcaaatctttgattcgtgggtcggcgcattgaatcaggcagattacagaacatacatcaaacccgtaatgaaccggattttttcagagctcgcaaaggagaatgtgccgctgatcatgtttggcgttggcgcaagccatcttgcaggtgattggcatgaccttcctctcgatgttgtcgggcttgactggagactcggcattgctgaagccagatcaaaaggaattactaaaacagtgcagggcaacctggacccgtccattttgcttgcgccatgggaagtcattgagcagaaaacgaaggaaatacttgatcagggtatgaaatcagacggcttcattttcaatcttggccatggggtatttcctgatgtcagtcctgaggttttgaaaaaactgacagcatttgtccatgaatattcacaaaacaaaaaaatgggtcaatattcctaagcatatcttttggtatcttaatgatatcctgtcaaaatgtttgtatcagatcattaaagagggtgtaaacagtgagtagaaagaaaatggggcttctcgtgatggcgtacggcacgccttataaggaagaagatattgaacgttattatacacatatcagaagaggcagaaagcctgaacctgaaatgcttcaagatttgaaagacagatacgaagcgattggcggcatttcaccgcttgccaaaatcacagaagagcaggcgcataatctggaacagcacttgaatgaaattcaggatgagattacgtttaaagcgtatatcggactgaagcatatcgagccgtttattgaagatgccgtagcagagatgcataaggatggcattacagaagcagtcagcatcgtactggcgccgcatttctccacgttcagcgttcagtcctacaacaaacgcgccaaagaagaggctgaaaaactcggcggcttaacgattacgtcagttgaaagctggtacgatgaaccgaagttcgtgaaatattgggttgaccgagtgaaggaaacatatgcgtcaatgcctgaggatgaaagagaaaacgcaatgctcatcgtatccgcacacagcctgccggaaaaaatcaaagaatttggagacccgtacccggaccagctgcatgaatcggcgaaattaattgctgaaggcgcaggcgtttccgaatatgctgtcggctggcaaagtgaagggaacacgcctgatccttggctcggacccgatgttcaggatttaacacgtgatttattcgaacaaaaaggctatcaagcatttgtatatgttcctgttggatttgtcgcggatcacttagaagtgctttatgataatgattatgaatgcaaagtggttactgacgatatcggcgcaagctattaccggccggaaatgccaaatgccaagcctgaatttattgatgctttggcaacagtcgtattaaaaaaattaggacgttaaagaaggcgatgaacatgagtgacggcaaaaaacatgtagtcatcatcggcggcggcattaccggtttagccgccgccttctatatggaaaaagaaatcaaagaaaagaatctgccgcttgaactgacgcttgttgaggcaagtccgagagtcggcggaaaaatccagactgtcaagaaggacggctatatcatcgaaagagggccagactcatttctggaacgaaagaaaagcgccccgcagcttgttaaagacttaggtcttgagcatttgcttgtcaacaatgcgaccggacaatcctatgtgcttgtaaaccgcactctgcatccaatgccgaagggcgctgtaatggggataccgacaaaaattgcgccgtttgtttctacgggtctgttttctttgtctgggaaggcgagagctgctatggatttcatcctgcctgctagcaaaacaaaggatgatcagtcattgggagaattcttccgcagacgtgtcggagatgaagtggtcgagaacttaatcgagccgcttctatcagggatctacgcaggcgacattgacaagctcagcctgatgtcgacattcccgcaattttatcagacggaacaaaagcatagaagcctgattctcggcatgaaaaaaacaaggcctcaaggctcaggccagcagctgacggcaaaaaaacaagggcagttccagactctgtcaaccggtttgcagacccttgtagaagagatcgaaaagcagttaaagctgacgaaggtgtataaaggcacaaaagtgaccaaactcagccatagcggctctggctattcgctcgaactggataacggcgtcacacttgatgctgattcagtaattgtgactgctccgcataaagcggctgcgggaatgctttctgagcttcctgccatttctcatttgaaaaatatgcactccacatccgtggcaaacgtcgctttaggtttccctgaaggctccgtccaaatggagcatgagggcacgggttttgtcatttcaagaaacagtgactttgcgatcacagcctgtacgtggacgaataaaaaatggccgcacgcagcgccggaaggcaaaacgctgcttcgggcatatgtcggaaaagctggagacgaatccattgtcgatctatcagataatgacattatcaacattgtgttagaagacttaaagaaagtcatgaacataaacggcgagccggaaatgacatgtgtcacccgatggcatgaaagcatgccgcagtaccatgtcggccataagcagcgtatcaaggagctgcgtgaagcacttgcatctgcgtatccgggtgtttatatgacaggcgcttctttcgaaggtgtcggcattcccgactgcattgatcaaggaaaagctgccgtgtctgacgcgcttacctatttattcagctaaaacctccgctttatcgcggaggtttttttgatgttcaatggcaatattgtgtaaaaaaatgattgaattgaacagcaggttatgatacatttgcatatgtacttaatgactaaaatgttcaaacggtcagtttcgaggtgaatacaatgtcaatagatcgaaaaaagctcattttggaggcggctacaaagtctttcacgcagttcgggtataaagcgacgacaatggatcttgtcgcaaaacttgcgaacgtggggaagggaaccatttatacttttttcaaaaacaaagaagagctgtttgacgagattttcactactttattaaaggaaatgaagcaaaaagcggatgaagcgatggagccgaaccttccgttccatgaaaatgtgcacagagcattgtttgccattctggagttcaggaaaacacatcagctgacgattaaaattttccaagagaatgccgagattggtacaatggcagttcaggaagtgatccagaaaatggagcgagccatactgtcttatatcaaaagtaagattgaagacgggatcaaaagcggcgcaatcaagccgtgcgaccctgaactgacagcctttgtgatgctgaagctttatatcgcgctcatttttgactgggaaaaacaacacccccgcttgataaagagacaattgcgggactgcttgaattgtatgttgtcaaaggattgtcagcgaactagataatcctttctctttgcaagaaaatgaccatttttcatgatgagtcagttttagaatggaggcatcaggatgaacacaatacgaagtcagtggaaagacatcgtaacaagtaaaaaattattgattcccatcatcgccattttgtttgtcccgcttatttacagcggcgtattcttaaaggcttattgggacccgtacggcacagttgaccagctgcctgtcgttgtcgtcaaccaagacaagggagcaacgtatgaaggagaaaaacttcaaatcggtgatgatctggtcaaagaattaaaggataataacaactttgattggcatttttccaatgatctcgaccaatcgttaaaggacttattgaatcaaaaatattatttagttgtcgagattcctgaggatttttctaagaatgccagcactgtattagacaaaaatccgaaaaaattggatctgaaataccatacaaatgcaggctctaactatgtaggggcaacgatcggcgaaaaagcgattgataaactgaaagcctctgtttcaaaagaagtgaccgagcaatatacgaaagttatttttgataactttaaagatatcgcaaaaggtttgagcgacgcgagcagcggcgcgaaaaaaattgatgacggcacaaaggatgcgaaaaacggaagcgcccagctgaaagaaaatctggcgaagctgaaggaaagcaccgctaccatcagtgacaaaacagcgcagcttgcagatggagcggctcaggtgacgagcggcatccaatcacttgacagctcgctcggtaaattccaggacagcagcaaccagatttatgataaatctagtcagcttgcagcaggatcaggcgagctgacaagcaagatgaatgaacttcttgctggacttcaaaatgtgcagaagggtgcgcctaatcttactaacgggctggatcagctcaacagtaaagcccaagaaggttctgagaaagcagcaaaagcggaaaagctcattaatgcgctcgatttaacgaagcttgaaactgctgtaaacaatctggaaaaatcagaaactgcgatgaaggaatttaaaaaacagctgtctgactttgaaaacagcttaaaaaaccgtgatcaggcattcaaaaatctcatcaattcgagtgatttcttaacagcggagcaaaaaagccagttgatcagctctgttgaaaagcagctgccgaaagttgatgcgcctgattttgatgaaattttaagtgggcttccttcagctgatcagctgcctgacatcgcaacgataaaaagctctcttgaagacgtgaaagcgcaggtggcgcaggtgaaagccatgccggaagctacatctaagctttataacggcgcaaaaacaatccaagatgcgattgacagattaactgagggagctgataagatatacaatggttcacagaagctgacagatggccaaactaaactgacagccggcatcggtgaatataataagcagttcgcaaaggcaaaagcgggctcagagcaattggtgacaggaagcagccaagtatccggcggattgtttaagctgttagacgggtctaaacaggtccaaagcggatcatcaaaacttgcagacggatctgcatcacttgatacaggtttaggcaagctattggacggcacaggagagctgtctagtaagctgaaggatgcggctgatcaaacaggagatatcgatgctgatgatcaaacatacggcatgtttgcggatccggttaaaaccaaagatgatgccattcattccgttcctaactatggaacagggctgacaccttatatcctgtcaatgggcttgtatgtcggcggcatcatgctgacggttgtcttcccgctgaaggaagcgtcaggacgtccgagaaacggttttgagtggttcttcagcaaattcaatgtcatgatgcttgtaggaatcattcaatcattgattgtggcgacggttcttctattgggaattggtctcgaggtagagagcacgtggagattttacgtgtttacgatcattacgagtctcgctttcctggcgatgattcaatttttggctacaacgatgggcaaccctggacgttttatcgcagtcattattttagtgctgcagctgggagcgagcggaggaaccttcccgcttgaattgcttccgaatttctatcaggtcatccacggcgcattgccgatgacctacagcattaacggattcagagcggtcatttcaaacggtgactttgactacatgtggcagatggccggcgtcttaatcggcatcgccctcgtcatgattgcactaagcattacttactttacaatgttaagccggaaggaagaatcatcagaagaacagccggcttcataaagaaaaagaacttgtttccttggaaacaagttctttttttgttacattccccatttaattatcaatcctgtataggttaatccgccgccaaacccgaaaagcaaaacgatttgatctttttgcagcttcccggctttcactgcgagatcgagcgccaaaacaattgaaaccgaagacgtgtttccgtaatgctcaacactagtgagcgttttttcaatcgggaacggtgttttttcacaaattgactcgatcatgcgcaagttggcgctgtgaggaacaaaccaatcgagatcatcagagctgagtcctgctttatgtaaaagccgttcaaattcgccagggacggttcttgcggcccatttatatacctcgcgtccgttttgcaccatttttccagaaccgacaagctgcacaccgtttatttcatttcgcagtccggcacgatacaaaatatcgccgccgttcccgcttgttccttgtacagacgcaagaaatcccggcgtctcttcatctcgttccactaacagcgcaccagcggcatcgccgaacagaacgcatgtcgttcgatcggtataatccgttacctttgataacgtctctccggcgatcacgagaattttttgatgaaggccagatgtgatcaatccatttgccaaatggaggccgtaagtcagcccggcgcatgtcgcattaatatccagcgcgccggtgctttcccagccgaaatattcctgtacgcggcatgccgtactcggaaaggcgtaatcggatgtggttgtggcaacgaggatcatatcgacatcatcaagtgttcctttataacggctcttgagattcttcaccgcttctatgcataaatcagaggtaaattgatgttcatctgcaatccggcgttctctcattcctgtgcgctgaacgatccattcatcagaggtatcaacgatcttttctaaatctgcattggttaaacgtctgctcggcgcataggtgccgatagctgtaatttttgcttttgacatatgaatcactccttatggtcagattataacactagatattagtatctggtactaaaaagaaggtttttttacaaaaaaagagaagtgtagaatagggaatctatgaaaaagaaaaaggaggctgaaaaatggtcagtcaagaagcagtagtctttttggcattatccggggctattgcgtttctgttgccaatcgggctgattgtatggtttaagcgaaagtatggcgcctcgcttaaagtgttttttattggcgctctcacgttttttgtcttcgctcagctgctggaaggcggcgttcatgtttatgtactgcaagtgaatgaaatgacgaaagaagcgatgcaacatccattatggtatggcatttacggctgcttgatggccggaatttttgaggagtgcggaaggtatatgatgatgcgattttttatgaagcgccatcatacttgggcggatggtctggctttcggggcaggccatggcgggcttgaagccatcctgattacaggcttgtcctctatctcacttattgtatacgcatttgcaatcaatagcgggacgtttgaacagcttttggtcaatggcgacgtcaaacaggcgcttttgccgatacaggagcagctgctgcatactccttcgtatgaatggatgctgggcggaatagaaagagtcagtgccattgccgtccaaattgggctgtctctgcttgttttgtacgcggttaaaagccgccggccgctgtttttgttgtattctattcttttacatgcactgtttaatgtaccggcggttttatatcagagaggaatcatagagcatgctgcagctgttgaaatcattattgctcttatagcggctttatcagtttattggattgtaaaagcaaaaagggtgtttcaataaaaggtccaagcagcagcaatgcccgcttggaaaaatgtgaatggaaatattcattaagcatgggtcatcagaatatttctgattcagtctttacaatgacagcaagaatgtctgtgttttttacaagagaaacaatggtgtttctttttcttcttctcgcaagggtcatggcattctttctttttcttgcaatggtcgtggaaatctttatcgaaccactcgtcaaagaaccaaaaatcatcgaaccaattgtgacaacgacatttctgttcatgtgaatgacgacagcacatagaaatccctcctcttcccatgctctctacagcatatgagagattgataggaaaagattggacgggtccctcgggaaaagagtatattttaagtagaaaataaaaggaggaatgccctatgacgtctgtacgtaaaacgatggagctcattaaagaactggtatcgatcccaagcccgaccggaaatacatatgaggtgatcaattatattgaaagccttttaaaagaatggaaggtagaaacggttcggaaccacaagggcggcttaattgcaacgcttccaggacgcgacacatcccggcatcgcatgctgactgcgcacgttgacaccctcggcgctatggtaaaggaaattaaagcggacggccggctgaaaatcgatttaatcggcgggttccgctacaactcgattgagggggagtattgccaaattgaaaccgcctcaggaaaaacgtacacaggcacaatcttaatgcatcaaacgtctgtgcacgtatacaaagacgcgggaaaggctgagcggaatcaagagaatatggagatccgcctagatgaacctgttcactgccggaaagatacggaggagcttggcattggcgtcggagactttgtgtcgtttgatccacgtgtcgagatcacatcaagcggatttattaaatcgcgccatttggatgacaaagcaagcgtcgccttattgctccgcttaattcatgaaattcaaacagaagacattgagctgccgtatacaacccattttcttatttccaataatgaagaaatcggttacggcgggaattcgaatattcctcctgaaacagttgaatatttggcggttgatatgggcgctatcggtgacgggcaggcgacagatgaatattcagtatcaatctgtgtgaaggatgcgagcgggccgtatcattatcagctcagaaagcatttagttcaattagccgagaagcatcatattgactataagcttgatatatatccgtactacggatctgatgcatcagcagcgatcaaatccgggcatgatattgtgcatggcctcatagggccgggaattgacgcttcccatgcatttgaacgcacccataaatcatctcttcgccataccgctaagcttctgtattactatgtacagtcaccaatggtataagggggaggaccaatgaagatttataagctgaaaagcacattcggctgggaaggtgatgacgggttgggagaacagctgattcagcagatccttgccggagaaaaaaccgccacgtgcgcgccgaaatcattgtattcaaaagatgaattgagggacgtttatcaaacagcgggtcagcttgttaccgtttatgataaacatgacaatccaagatgcaatataaaagtgacagatgtctttgaaaccacctttggtgcgcctgatatgaggttagtcaaaggagagggcaatggagaccgaattgaggagtttcaagaggatcatcggatggcatgggcggaactgatcaaaagcggtgaactggagctgaatgaggatactgttttgattacagaactgtttgtgcttgttaaagattaaaaaagcctgcggggcaagaaccccgcaggcttttcattaaccagaaatggttgcgttttgttctgttttcgattgggacataacagtttctgctttcgcaggattaaacatgccttcccatttagacatcacaacggcagcaagcgcgttaccagtcaggttgacaactgtacgtgccatatccatgatgcggtctacgccggcaataaaggcaagtccttcagccggaacgccgatggtgccaagcgttgcaagcaagacaacaaaagaagtaccaggcacggcagccatccctttggatgtcaccattaagacgagcacaagcgtaatttggtgccaaatcgtcaaatcaatgccatatacctgtgctaaaaagagtgcggcaatagattgatagagaacggaaccgtctaagttaaacgtgtaaccgatcggaatgacaaatgaaacaatgccttttggacatccgattttctccattttttccatgatacgcggaagaaccgtttcagagctggacgtactgaacgccagtaagatttcgtccttcatgtaagcaaggaacttgaagatgctgatgccggcaatttttgcgacaatcccgaaaataacaattaagaagaaagcaagcgcgacataaaccaatccgacgagctttccgagagagataagagaaccgagtccgaatttagacacagtcactccgataagagcgaaaacgccgaatggcgccactttcatcacaaggtttacaacgtggaacatggcatgggatacaccttcaaaaaaggctaatacaggcttgcctctttcaccgattgcggaaatacccaatgcaaatagtactgtaaagcagatgatggctagaagatccccttcgaccaatgactggaagaagtttgtcggcacaatatggaggaacgtttctgccactgatttattactttgttctttttcagtttcaacatattgactgatgtctgatttttgagcttcgtgtatattaactcctgtacccggatggaagatgtttgcaagggctagtccgagaataatggcaaaagtcgtgatgatctcgaagtacagaatcgttctgaagcctaatttaccgacttgctttccatttcctgcaccggctacaccgatgattaagctggagacaacaataggaatcactatcattttgattaagcgtaaaaagagatccccgattggctgcaggtaagtaggcaatgctgggttgccataccaaatgacgccaacaatgacacctagaataagtccaacgaatatttgtgtggctaatccaaacttaattcttttcatagattacctcccaaaaaacaaagtatcaacatatatcatgaatagacatatatttaatctcactattagatcaaattataatagataagaaatcaattcgtctatagtaaattatatttcgaaaataaagaatattcaatgacattatgataatcaccagaattatctaaaaacaggtgagctttgacctaacctgactattatttcaaaattaagagatatgtgaaaaaataagaaaatcccacgcataaggcgcgggattttcgctcattacaaatcgtttacttttatacagtcattgcagatattaccataacactcatgctgctcttctatcttttttccgcattccgcacactttttcgaaggcaggtttctaaaaaattctgtgattttccccagcataaccaatccctctttcccctttgtagtgatttcattgtaatataacagattaaaaaaatcaataactgttttgatacaatgtttaaaacatgcttttttcaagaaaaatgggtatattgaaggaggatcaatttttttgaaaagataggaggacattatgaaagttacagttatcggatgctatggcggttttccggccgcaaatgaagcgacgtcaggctatttgtttcagtcaggtgattactctctgcttgttgattgcggcagtgccgttttgtctaagctattcggatatgtgccggcggaaaagctggatgcggtcgttctgtctcattatcaccatgaccatatcgctgatatcggaccgctgcaatttgccaagcaagtcggttcgtttctcggcaaaggagagcatacgcttccgatttacggacatgatgctgatatagaacagtttcaaaagcttacatataaaacacatacaaaagggatcgcctatcagccggatcagccgttgactgccggtccgtttacgatcacctttttaaaaacgattcacccggtgacgtgctatgccatgcggattactgacggcagccacactgtcgtttatactgctgattccagctatcaggattcatttataccgttttcgaaagatgctgatttattgatctcagaatgcaatttttatgccgatcaagacggaacaagtgcaggccatatgaacagcctggaagccgggcgcattgcaaaagaagcgggagcgggagaactgctgctgacccatttgccgcattttggcgtgcatgacaaccttcgcaaagaagcgaaaaccgtttttaacggagaagtgaatattgcgaaatcaggttttgtgtgggaaggataaaggaggagcaccatgttatttatagacaatcaaaatatcaatgatccgcggatcaatcttgctattgaggagtactgtgtaaagcatttagaccctgaacagcaatatttgctcttttatgtgaatcaaccgtctattatcattggaaaaaaccaaaatacaatagaagaaatcaatacaaaatatgttgaggaaaacgggattatcgtcgtccgccgtttatcaggcgggggcgctgtgtaccatgatctggggaacttgaacttcagctttattaccaaggatgacggggacagctttcataactttaaaaaattcactgagccggtgattcaggcgttacatcagcttggggttgaagctgaattaagcggccggaacgacattgtagtggatggccggaaaatatccggaaacgctcagtttgcaacgaaaggccgtattttcagccacggcaccctcatgtttgattcagccattgatcatgttgtatcagcattaaaggtgaaaaaggataaaattgaatcaaaaggcatcaaatcgatcagaagccgagtggcaaacatcagtgagtttctcgatgataaaatgaccaccgaagcattccgcagccatttgcttcgccatatttttaatacaaacgacattggaaacgtgccggagtataagctgacggaaaaagattgggagaccattcatcaaatttcgaaagagcgctatcagaattgggattggaactacggccgctcaccaaaatttaaccttaatcattcgaagcgttatccggttggatcgatcgatttgcgcctggaagtcaagaaaggcaaaatcgaggactgcaaaatcttcggagatttcttcggtgtcggtgatgtatctgaaattgaaaacctgctggtcggaaaacaatacgaacgcagcgtcatcgctgatgtgctcgaaggtgtgaatctcaagcattactttgggaacattacgaaagaggatttccttgatctgatttattaaggcaaaacacatcgtttgaaagagcggttgtgtttttgaaataatggaggcaggagggattcacatgaaagtgtttttaatcggagcgaacggacaaatcgggcaaagacttgtctctttattccaagataatcctgatcattccatcagagcgatggtcagaaaagaagaacagaaagcgtctcttgaagctgccggtgcagaagctgtgcttgcgaatctggagggcagcccggaagaaatcgccgctgcggcaaaaggttgtgacgcgatcattttcacagctggttccggcggcagtacaggctatgataaaacactgctggtggatctcgatggagcggcgaaagccattgaagctgcggacattgccggaatcaaacggtttattatggtcagcgccctgcaagcccatcaccgtgaaaattggaatgaggcactcaagccttattatgtggccaagcattatgctgataaaattctggaagcgagcggtttaacctatacgatcatccgtccgggaggccttcgcaatgagcctggaacgggaactgtttcagcagcgaaggatctggagcggggatttatttcccgtgatgacgttgcaaaagcggtcattgcctctttagatgagaagaatacggaaaatcgggcctttgatctgacagaaggagatacgccgattgccgaagcattgaagaaactatgacagtactgacactcagggctttttgctcttgagtgtttttttctgtttctctataatggaggagaaagcttggcttcaataatgaatgactattcattcactttaaggggtgggagaatgaatcttgtttcaaaattggaagaaacagcatctgagaagcccgacagcatcgcatgcaggtttaaagatcacatgatgacgtatcaagagctgaatgaatatattcagcgatttgcggacggccttcaggaagccggtatggagaaaggggaccatttagctttgctgcttggcaattcgcctgattttatcatcgcgttttttggcgctttaaaagctgggatcgtggttgttcccatcaatccgttgtacacgccgacagaaattggttatatgctgacaaatggcgatgtaaaggcaatcgtgggcgttagccagcttttgccgctttatgagagcatgcatgagtcgctgccaaaggttgagctcgtcattttatgccagacggggaggccgagccggaagctgcggacccagaggtcaggatgaaaatgacaacgtttgcaaaaatattgcggccgacatctgccgctaaacaaaaccaagaacttgtccctgatgataccgcggttattttatatacgtcaggaacgactggaaaaccgaaaggcgcgatgctgactcatcagaatttgtacagcaatgccaacgatgttgcaggctatttgggaatggatgagagggacaatgtggtctgcgctcttcccatgtttcacgtgttttgtttaaccgtctgtatgaatgcaccgctgatgagcggcgcaactgtcttgattgagcctcaattcagtccggcatctgtttttaagcttgtcaagcagcagcaggcgaccatttttgccggtgtgcctacaatgtataactacttgtttcagcatgaaaacggaaagaaagatgatttttcttccatccggctgtgcatttcgggaggcgcggccatgccagtcgcgttgctgacggcgtttgaagaaaaattcggtgttaccattttggaaggctacgggctctcggaagcatcacccgtcacgtgctttaacccgtttgacaggggcagaaagccgggctccatcgggacaagtatcttacatgtcgaaaacaaggtcgtagatccgctcggacgcgagctgcccgctcaccaggtcggcgaattgatcgtgaaaggccccaatgtgatgaagggctattataaaatgccgatggaaacagagcatgcattaaaagacgggtggctttatacgggggacttggcaagacgggatgaggacggctatttttacattgttgaccggaaaaaagacatgatcattgtaggaggatacaatgtgtatccgcgggaggtggaggaggtgctgtacagccatccggacgtcaaggaggcggttgtcatcggcgtgccggacccccaaagcggggaagcggtaaagggatatgtggtgccgaaacgctctggggtaacagaggaggacatcatgcagcactgcgaaaagcatctggcaaaatacaagcggcctgccgccattacgtttcttgacgatattccgaaaaatgcgacggggaaaatgctcagacgggcactgagagatattttgccccaataaaatgaaaaagcgaagcggttagcttcgctttttcattttcaatcttttgcttcttttttaataatatttagcagcgcctttgtatcatttttgctcaatttgtagtatgtgccatccttcgaaaaaacggcttgctggctgccgtcaatccatagtctgaatgagtcataccggtctttatgaaacttgattgtcccttcgtaatcaggggctgatgttttttctgtcttcacctgttttccctgattcataatatccagcatatctttgacgtgctgtcttttttcaatctcgatatcttcctggccgcttgaagacagtgtgatcaaatccgcgtctaccgattgatacacatcgcctgatcggctgtaaagataaaaaaatgctataaacacaagaccgattaccacgatggctgccactatttttttcatttgcatcactccaaacattgttagttttcccagcgttcgggctttccatgcttaaaagggtggaaaagtgcggaacacagcttggttctaagaatttgaatttatgattacaatagaagtaacgggttgatgtgaggagtgaggcgttatgcgcaagtggattgcggcagcaggacttgcttacgtgctgtacgggctgtttttttattggtattttttcctgtcgggtgattctgcaataccggaaaccgtgaaagggacgcaggctgatccggcttctttcatgaagccgtctgagctggcagtggccgagcagtattcgaacgtcaagaattttttattttttatcggggtaccacttgattggtttctgttttttgttctgctggtcagcggtgtttcaaagaaaatcaagaaatggatggaagcggccgtgccttttcggtttttgcagactgtaggttttgtgtttgtgctttcgctgattacaacattggtgacgctgcctttagattggataggctatcaagtatcgcttgactataacatttccacacagacaacggccagctgggctaaggatcaggttatcagcttttggatcagtttcccaatctttgcgctttgcgttctcgttttttattggctgatcaaaaggcatgaaaaaaaatggtggttatacgcctggttgttaacagtgccgttttcgctttttctgttttttattcagccggtcattatcgatcctttatacaatgaattttatccgctgaaaaacaaagagcttgaaagcaaaattttagagctggcggatgaagccaatattccggctgatcatgtatatgaagtgaacatgtcagaaaaaacaaatgcgctgaatgcctatgttacaggtattggggccaataaacggattgtattgtgggatacgacactgaacaaacttgacgattcagaaattctgtttattatgggccacgaaatgggccattatgtcatgaagcacgtttacatcggtctggctggttatttgctcgtgtcgctcgccggattttatgtcattgataagctttacaagcgggcggttcgcctaacccgcagcatgtttcatttagaagggcggcatgatcttgcggcacttccgctgttattgcttttgttttccgttttgagctttgcggtgacgcctttttctaatgctgtctcgcgttatcaggagaataaggctgaccagtatgggatcgagttgacagagaacagagaagccgctgttaaaacgtttcaggatttggccgtgacggggctgagccaggttgatcctccggtgcttgtgaagattttcagaggcagccatccttcgatcatggaacggattcaacatgcggagaaagaagagaatgcgccggaacatcaggatgctgacaaataaaaagaagcaggtatggaggaacctgcttctttttactattattgtgcagctgcttgtacgttgattaacccttttccatagtagaaagagtttccaagatatgttgcagtgctttctaaacgatcacggacttgcgcgtttgtccaagtcgggtgcttagaaagaattaacgctgctgctccggcaacgtgaggagtcgccatggatgttccgttgtaagcaccgtaagtgccaccaggaagtgtgctttggatggatacgccaggagccatcacatcaagctcagaacctgcgcttgagaatgaagctctttggttgctgctgtttaccgcacctaccgcaatagtggaaggatattttgcagggtagccgactgtgcttgagcttccggacgaaccttcgtttccggcagcggcagcaacgacgataccgctggaaacggctttatcaacgactgttttcagcgctgtagaaccagtaggtccgccaaggctcatgttgataacatccatattgttggaaatggcccactcaatgccgttaataatccagctatattggccgcttcctgttgaatcaagcacttttactgcatataatgatgcgcttggcgctacgcccagaacaccgattgagttattaagagcggcaatcgtaccggctacatgcgtaccgtgagaactgccgtcctggtatgggtttgtttcagaaggtacgaagcttgctccgcctctgacgtttaagtcaggatgagaagagtcaattccgctgtcaataacagctacttttacgttagagcctgtgtagccttgagagtgaagagccggcgctttaatttgagaaatgccataaggaacagattgcgcatattcatgtgcaatatgatcttcttccacatatgcaacgctcggatcttttttcaattcttttacagctttttcatccaatgttgctgcggccgcgttaacatacttaaattgcttttgaacctttccgcctttttcagaaataacatcctttttcttggcggaactcatggcactcattgtctgtttaaatccaacaatgtatttcttttctgtactgctttttccggcagcctgcgcagacatgttgctgaacgccatcgtaaagattaatgttaacgcaaacaacaagctgatccacaattttttgcttctcactctttaccctctccttttaaaaaattcagagtagacttacttaaaagactattctgtgaatttattgtaatagatggaataatattttagtagacccatttttttgagatgattttatctctatttaggtatatcatctctcgctatttccgtagagactcgaaataactattttcatacagaaaagaacgaaaatagacatgagtaaatgttcattatgctgaaatgtcatgcttttttaggttaaatgctcctgagtcccggcaaatttctgtcgaaaaaattcgttcaaatgacctgcgtgtgcttccgtgagaacaatggatattatcgtgatattttttcaaagcatgatgataaaagtattctgaaaaataaactttacagaaaaggtatagaatgaaaaaattattgagagggaggaagaaataagatgaacattcgccaagcaaagacatcagatgcggccgccattgcgccgttgtttaaccaatatcgggaattttatagacaggcatccgatttgcaaggggcagaggcttttttgaaagctcgtttggaaaatcacgagtctgttattttgatagcagaagaaaatggagaattcataggctttacccagctctatccaacgttttcttctgtgtcaatgaaaaggatctacatattaaatgacttatttgtcgttcctcatgcgcgtacaaagggagccggcggccggctgctttctgccgcaaaggattatgcagaggaaaacggggcaaaatgtttaacacttcagactgagcaccacaaccggaaggcaagaagcttgtatgagcaaaacggctatgaagaggataccggatttgtccattattctctcaatgtgccggcgaagtgaaaatggcggcttgatgatttggttttttgaacgttcttcggttacgatataaatgaaaaggagtgtgccgaatgtcaacgttatttcaagcattgcaggcagaaaaaaatgccgatgatgtttcagtccatgtgaacaccatatcaacagaggatttgccgaaggatggtgtcctgattaaagttgcttattccggcatcaattacaaagatggtctggccggaaaagcaggaggcaatatcgtcagagagtatccgcttattttaggcattgatgctgcgggtacggtcgtctcttccaatgatccgcgttttgcggagggggatgaggtgatcgcgacaagctatgagctcggtgtctcccgtgatggtggattaagtgaatacgcttcggtgcctggtgactggctggtgcctttgccacagaatctttcgttaaaagaagcgatggtgtacggaacggcgggatttactgcggcgttatcagtgcatcggcttgaacagaacggtctgtctccggaaaaaggcagcgtgctagtcacaggagcaactggcggtgtcggcggaattgcggtatcgatgctgaacaagcggggctatgatgtggtggcaagtaccggaaatcgggaggcggctgattatttgaaacagctcggtgcaagcgaagtaatcagcagggaagatgtctatgacggaacgcttaaggcgctgtccaagcagcaatggcagggggcggttgatccagtcggcggaaaacagcttgcctcgcttttaagcaaaattcaatacggcggatctgtcgcagtgagcggcttaaccggcggaggagaagttccggcaacggtgtatccttttattcttcgcggagtaagcctgctcggaatcgattcagtatactgtccgatggacgtcagagccgctgtttgggagcgcatgtcttctgatctcaagcctgatcagctgctgaccatcgtggacagggaagtatcattggaagaaacgccgggtgcgttaaaagatattttgcaaaatcgcattcaaggaagagtgattgtgaagctttaacaggatcagcttgcagagaatgttatttttctgcaagcttttttgtggacaggatgatcagctgctgaactgctgtgtcgtgaaacaagattttcctgtaagccgaactttctcttctcatttaaaaaataattggtgataatgattctcattccgtgttatactactcttggacatcttaaccatagaaactaccaacaggagagactggaacatatgaaaaaaacactgattattcttacagttttacttctttctgtcttaacggctgcttgctcgtcttcaagcggcaatcaaaacagtaaagaccataaagtggcggtaacacatgatttagggaagacaaatgtacctgagcatccggagcgggttgttgttcttgagctaggttttattgatacactgcttgatctcggcattacgcctgtcggggttgccgatgacaacaaagcgaagcagctgatcaacaaggatgtgctgaagaaaattgacggctacacatctgtcggcactcgctcacagccaagcatggaaaaaatcgcttcattaaaacccgatttaattattgctgacacgacccgacataagaaggtgtacgatcagctgaaaaaaatagcgccgacgattgcacttaataatttaaatgctgattatcaggatacaattgacgcttcgcttacaattgcaaaagcagtcggcaaggagaagaaaatggagaaaaagctgacggcgcatgaagaaaagcttagcgagacaaagcagaaaatcagcgcgaacagccagtccgtgcttttgatcggaaatacaaatgataccattatggccagggatgaaaacttctttacatcgagacttttaacacaggtcggctatcgatatgcaatcagtacgtcaggcaatagcgattcaagcaatggcggcgactctgtgaatatgaaaatgacactggagcagctgctgaaaacagatccggatgtgatcatcctgatgacaggaaaaacagatgacctcgacgccgacggtaaacgcccgatcgaaaagaatgtcctttggaaaaaactgaaggcagtgaaaaacgggcatgtataccacgtggaccgtgcggtgtggtctctgcgccgcagtgtagacggggcgaatgccattttggacgagcttcaaaaagagatgccggctgctaagaaataaaagaaaagacaggcaaacgcctgtctttttcttatttgataaagccggataagtggctgttgatattatagtcttttatccgccatttttcttctgcaaattcaatgttgctgaggcaggcgttgacgagacgggtgctttgaagctccgggtcaccgccggatatttctgtcagcagggcgtgaattgccgcaccgtgcgccacgatcagcaccttcttgtttggatacgcctggttcacttttgccaaaccgcccatcagcctgtcagtgagttcttctaaggtttccatattcggatagatgttatctggatagcgctttgtccgttcctccagcggcatgccctccgcgtcgccgtaatcgcgttccttaaaatcatccatctcgactatcggaagatgcagatattcattaataatttccgcggttcttttcgctcttttcagcgggctcgtcacaataatatcccaagaaaagtcctttacatattctccggtttctcttgcttggcgttcacctgttgcgtttagcgggatatcggttttgccttggcatttttgctgcaggttccaatcggtttctccatgtcttactaaacaaacggctgtcataaaatccccttcctgactttattcatatcgctattatactaaatcgaaagcgtgtgtcctatgaaaaagcctatgcaagaacttcaaataataaagccagtccgattccgccgccgcttccgatggctgcaacagcatattgacagtctggccgtcttttcgcttcataaaacaatctggttaccagagctgcacctgatgcaccgtaaggatggccaagagctaatgcgccgccgcgcacattgatttttgaaaagggaatgccgagttcttgcgagcagacacaaattttgacggcaaaggcttcattgatttcaaataaaccgatatcctcaggtgttacatcgtgtgtatgtaagagattacggatcgcatcaaccggtgccgcgggcggatagttggggtgaatcccgctgacagcgctgccgataaaccggagaacaggcttaagtcccagggctgccgctttttcttcttccattaccaaaagagccgctgctccgtctgctatgccactgctgttggctgctgtgactgttccggagctggtgtcgaaaaccggctttgcacggggaataatcgcttctattggccgcgttttcaaaaatgcttcgtccgtctccaattccccgagagcaacaacttcttcacggtaaaatccttcctcatgcgcgttcctgctgcgttgatggctgagaagcgcgtactcatcctgcatgcttctgctgatggaatagcgtgcagccgtatattctgctgcaatgcccatgtctggatcgccaatcgcatctggagaaaagcgggcccgttctgaaaaagggattggctgctgctttctgagccgcccgcgatatacatcgtgccggctcccgcttgaataaggctgcaggcatagcgcacagcttcaaggcctgagccgcactgtctgtcaattgtcattccgggaaccgataaaggcagtccggcttgaagggctgacagtctggccaggttgccgcctctgccagtagcgtttccgagaatgacctcgtcaacttgatcctctagctttcggctgagacagcggatgatgggagccgccaaatcctccggcaggaagggcttcagcagtccgttttgatttccaaagatcgttcgttttgcatcaacaataaccgcattcatttatactgtatactctcttccagccattttttcactctggaacgggcaatttttccgctgctcgtttccggcaagctgtctgcaaacacccattttttcggaattttataggaggctaatttctgtttacaccaggctttaagtgttctggcattagcgtttccaagaatgacagctacagcgatttctccccaatactcgtcgggaatgccaacgacagccgcgctttcaacctctgggcaggcgagaagcacacgttcaatttcttctgggaaaatatttaatcctccgtacacgatcatcccgttttctcttcctgatatgtatagaaagccctcttcatcaacgtagcccatatcatctactgtcatccattcatctggtgtgctgccgttcacatagccggaaaacctcatcgggcttttgacaaatatttttccgatttctcctggctggcagcgttctcctccagcgttgaggatttcgatccggacattatgaaaagggcggcccgctgaatgcggcttccgtttgctgtcttccggtgaagaaaacgtcacaaaactaagctctgatgtgccgtaaaaatcgtacagcttgagatgaggccatgcagcggcaagcttctccttggattctgccggccagtctgcgccggatgaaatgattttgacgggactgtcgggaaaaccctcaatccttgcgagggcgtctgtcatcgtcggtacggtatagagaacactgatggattcacggcacagccattccttcgctttggcaggagaaaactttttcagcaaacaaacggttcctccaagaaacaaagtgctgactgccccgtataagaagtgagaggacattaacgtcccgggaatcaataccgtgtcatttgatgaaatcgaaaaatctgtttctgtacaggtaaagctctctatccatgagcggtgagatcgcgtaaaggccttcggttttcctgtcgagcccgacgtaaatcccatataaaaagggtgctccggatcaatggtaggcaagggatcagcggttgcttcagaaatatctgccatacagttatccagcaaaacaacaggtgtctggctatctgtcagtttgtttttgaaaaaggctaaagtaaccacaagatccgcattgcttatggacagccgctccttacattcagccgggctccagcgtgtgtcgatgggaatggctgtgcatccagccgctgcggctccggcaaacagatgtaaaaacgccagactatttgggagcaggatcgccacacgattcggcatgctcggctgtgaccgcagccaatttgcggtttgagagacaagccgatcccaatcatggtacgtgatttgctccgaatcagtctggatcgctacacggccgggcgatgtttcggcagtagatgaataggtatgagtaattgtcatgtagtgtcatcctccttttgtaaacatcgtatcagaaagagacaaggcttgagtgatttttatcgctagaaatgcagatacagccgcttttatcaaatcaccaggcacatatgcaaggctcatgaaggcggcctgtgacaaatcaatatgcatgataaaagcttgtaccggtataccaagcagataaataaagatgatgccgaatacgatatgagtgaaaaagagacgcgatactgtcaccttccgcagcctgttagcggctaaactgatcagccatgaagcgaggggataagcaatcaaaaagcctgcgctcggtccgaaaaacacaccaaaaccgcctcgtccgccgggcaacagcggcgctccgaaggcgacgagcagcaaaaagacaagctggcttaagaaagcagactttggcctgaggatgccgcctgccaacatgacaccaagcgtttgcaatgtaatcggaacgggtgtaaaggataagaagagagggggcataaagccgagcactgccatcagtgcggtgaaaatagcaatatgcatcatgtcgattaatttcagcatgtgaaatcctccaaacagtaatcaaatatggttatacaataaatgcaggtaattattatgtcaactgatttttaatttaagtttacataatgaacgcaaaaaaaccggccgtatggcagaccggtttttgatggttattcttctgtcaggatgacaagcgaatcaacggaagcggccacatgggaaaccgcgcggctgacttcctgaagccctccaagaaaggcttgcagatcgacgtcgattttgcctgattgctctttgctgattttcatgctgtggacgatttcatcgaataagcggttaatttgcgtcattttttctttactttcgctgactagctcattcacgtctttgatatgcttggatacaatgttgatttgtgtattcgtattgttcacaagctcagaaacagtagagacggtttttttcgtatcctcagaaagcttccgcacttcatttgccacgacagcaaagcctttgccgtgttctccggcgcgggcggattcaatagatgcattgagcgagagaaggtttgtttgttcagctatgcctgtgacgatgccgaagattttttcaatttgctgcgcgatttcatccagcttgaccatttctttttcgatttggacaaggcttgtgtcaattttgttcatctgtttttgctggacttctagctctttttttccgccgatcgacttttcttcaacagtgctggatgttacagtgccggctttggatgcttgagaaatgccttcagatttgtccacaagctcttgaactgatctgcttgtttctgaaaacagattggcaatcgatccagaggtttcttgaattttctgatgaagaaggtttttcttttcttcttgttcatcacgggtttggttgtactcgctttgaaacgcttcaaggacaagctgctgttctaagttcaagatttttgttgttgctttaatggcttttagcagttcttgctgatttgaaatggacgcttcataaatgtcaatcattgacaaaagaagctcttgaaacgcacccatataccattttggcaaaaggccgattcttaaatggatggaggcgattcggttacgcttttcaatgaattcatcatcgataacgcctgcaaacatttcctgaatatgccgttttaacgtttgttttaagcggtcaactgagctgtgatcattaatgatatccatcaatgagctttcatggtcaaggtttttataaaacgcatcaacgatatttacgatattttcttgaatgagtggctgaagctgctctaacacgtaaagctcagcatctcccaacctgaccattttgagctgttttttgacatctgcatgtttgtttgtgagctgaatgcggtttttttgctgtccgtttgaatctgaaaagtaagctgtttcttgttttctgtcttttttaaataacaatacaatgatcccccttgggaaaaatataatttttactttttggctttttaagcctttttcttttttatcggccaagggaaacatgaatgaagctgcagatgaaaaatatttgaaaaaccgttcattaaaatgaacggtttaatcgagatctatttgttttaatggtttaatggccggaccctctacaacttcgccagatggcttaaagcgtgacccgtggcacggacaatcccacgtatgctcactgtcgttccactcgacctcgcagcctaaatgggtacaagtcgtatcaacgagatggaggcagcctgtctcatcccgaaatgctcccgctcgcctgccgtttatggtgacggctttcccttctcctggcgaaatgtcttcaaattggacatcaggcttttcaagctttcctttaatcaaatgcttggcgacatcggcattgtaggaaatcactttctgcaacccgggattcagatggaaacgggacggagtgaaaatgctttcgtatggattgtcttttttctctacaaggtctgacaatagagtggctgcgactgctgaggacgtcatgccccattttttgaacccggtcgctactagaatattgtcctcattttccgacatcggcccgataaacgggattttgtcgatcgtcactagatcttgtgtggaccaataatatggaatgctttcgatgccgatggagctttcggccagttgtctcagtgtttcataatgtgtagacatggcttttccctggcctgttttatggcttactccgctgaagagaatcagcttttcaccgtttacaaccgtatagcggagcgccactgacggctgatcgatactcaaatacatgccctcgggatactcgatcttcggcttgatggcaaggacataagatctgtcggagtacattctcgcagcatataatccgcctccgtcataaaaagggaagtgggaacagcatatgataaagcggctcttaatggcgtgccggctttttgttaccacttcgggcctttcgccttttttgatatcaagcgcaacggtctcttcataaattcggccgcctttttgaacaatttgctccagaagcgcttttaagtattgaagcggatgaaattgagcttgattcttcatgacaagcgccagcttagaacctaagggaattggaagatccttgataaggtctctttcaattcccagctttgtgtatgcctcatgctcggtgcggattttttgaacatttttttcatttgccgtataaagatatgcgtcttgctcgatccattcacaatcaatttgatgttcatccacaatgccttttatgtaatcaattgcgttttggtttgcttcataataaagcctcgcatggtttaatccgaaatggcggataaattcgtcgtatatcatgtcatgctgtgcggtaactttagcagttgtatgcgcagtggttccgttaagaacctgatttgcttcaatcaaaacgacacggaagcctctcttcgtaagttcatatgccgttgtgattcccgtaatcccgcctccgataatggtgacgtcacattcagtgtcctcttgaagcgcaggaaaagaaggcaggtcagttgatgttttccagtatgtttcaggtgcttcctttgcaaaatgttgattagccaagccgttatacctccaatcagatttattcttaatttttccatattctatcttttcatacataggaagcaggcattgttcataacataataaggttgaaaaggagtgatttcattggcgaatcaaaaaaagaaaacattaccgcctcagcaccagaaccagcagcctggttttgaatatctgatggacccgcgtccggtttttgataagccgaagaaagcgaaaaaattagagggcaaaaccgctattattactggaggagacagcgggattggacgcgctgtctcggtgttattcgcaaaagaaggggctaatgtggtcattgtgtatttgaatgaacatcaggacgccgaggaaacaaagcagtatgtagaaaaggaaggggtaaaatgcctgctgattgcaggagatgtcggggatgaagcgttttgcaatgatgtggtcgggcaggcaagccaagtgtttccatccattgatatattggttaacaatgcagctgagcagcatgtccagccaagcattgaaaaaatcaccagccaccagctgatgagaaccttccaaacaaacattttttccatgttttacttaacaaaggcagtgctgcctcatttaaaaaaagggagctctattattaataccgcttcaattaccgcctataaaggcaataaaacgctgatcgattattcagcgacaaaaggcgcgatcgttacgtttacaaggtccctttcccagtcgcttgttcagcagggcatacgggtcaatgcagtggcaccgggtcccatttggacaccgcttatcccggccagctttgccgcaaaagacgtggaagtgtttggttcagacgtgccgatggaacgcccgggacagccggtcgaagtggcgccaagctatctataccttgccagcgacgattccacatacgtcacagggcagacgattcacgtcaatggcggaacaattgtgaacggataataaaaagccaatccttgaaggattggcttattcgctctgcttgagcgctgcatattctttagagagcgtaagaaacgcatctttatctttttcgtccaaggctttgttaatttggtccgtcagcatggcaagccgacggttatacaaggattcatcgagcaccatttgaatgtaaatatccgtcattgtgacatcgaattcttttgttttttgcgtgttgcgggacttcatgagctcagtgtacgattttttctctttcataaagaatcccccaatgccttttttatagtatatggataacggtcgaaaaaatcaataaatttttataatttttagacaactaatacttggcaatctatcgacatatcctgcaaaatgccgtaaaccggcaaatcttatgaaagtaaaatcggtttattactagtcatttagtaccattaaatatcattaaaagatgattttatcttaaatgttaaaaaaacctgtcgttttataaaaacagatgatagattattagtataaattttgcagaaaaaggatggaggccataatatgagtcagaaaacagacgcacctttagaatcgtatgaagtgaacggcgcaacaattgcagtgctgccagaagaaatagacggcaaaatctgttccagaattattgaaaaagattgcgtgttttatgtcaacatgaagccgctgcaaattgtcgacagaagctgtcgattttttggatcaagctatgcgggaagaaaagcaggaacttatgaagtgacaaaaatttcacataagccgccaatcatggtggacccttcgaaccaaatctttttattccctacactttcttcgacaagaccccaatgcggctggatttcccatgtgcatgtaaaagaattcaaagcgactgaattcgacgatacggaagtgacgttttcgaatgggaaaacgatggagctgccgatttcctataattcgttcgaaaaccaggtataccggacagcgtggcttagaaccaaattccaagacagaatcgaccaccgcgtgccgaaaaggcaggaatttatgctgtacccgaaggaagagcggacgaagatgatttatgattttattttgcgtgagctcggggagcggtattagaaaatagaaaggagctgacctacagggcagctcctttcataaacctatgccgtcggaattcctccggtgatgccatatacctgagatgtcacatagcttgaattctctgaagctagaaatacataaacatcggccaattccactggctgaccagcgcgatttaatggagctggcggcgtgccttgtccgaatttcgggatgttttccgtcggctgtccgccggaaatttgcagcggtgtccaaattggtccgggtgcaactgaatttactctgatgcctttggaagcaagctgttttcccagtccaacggtaaagccgataatggcgttttttgttgctgcgtaatctaacaacatcgggcttggattatagccttcaactgaggtagttgtgataattgaagctccctccggcaaatacggaagcgccgcttttacaacccagtaaagggaaaagacgttcacttcaaatgttttatagatttgttcagtaggcagatcttcgatgttttcgaccgcttgctgtttgcctgcaacgagcgctagcacatcaagtccgccgagtttgtgatgcgactgtttgactagatcttggcaaaaggattcgtcgctcaaatctccggggatcagcactgcttttcggccttctgcttcaatcagctcttttacctcttcagcatctggctgttcctcgggcaagtagttaatggccacatcggcaccttctctggcgtaagcaatcgcggcagcgcggccgataccggaatcgccgcccgtgacaagcgcttttcgacccgttagtttacctgatcctttgtagcttttttctccgcaatcagggacaggcttcatgttcttttgcaggcctggcggctcttgatattgttcaggaaattcatcatgaaaaaatgcttttataggattcgtaagatttgaatcagacatcatcaacgctccttttctgtttggtgtacattcgtatgtgtacccctgagcataagcagaaaaacatgttttggcagtttgaatagtgaaggaaaaagaaaacaagaaaaaacaaagacttcttccatatttatcttgtcaaataagactatatgaattatgataaattcgagctataaatcaactaaatattgggtgttgggggagtgaatcgtcatgaaaaaagctgccgcggttttgctgtcactcggtctcgttttcggtttttcatacggagctgaccatgtggcagaagccaaaacaaaggtgaaggtctataagaactgcaaggagctaaacaaagtatacaaaggcggagtggcccgcacatcgaaggtgaaaaacaaaggcggaaaaacgaagtacaagccttacgtttctaaggcgctttacgatgccaataaaaacaaagaccgcgataaagatcttatcgcctgtgaacggtaattaagaaaaagcaatctggtgtccagattgctttttttatgcttatgcagcctgatcggccgcagcgcttttcgcctttcttgtcataaggctgactgccatcatgaccgagatattcaaaagcagggcaacgatgccaacattcaggtcttttgcggcttgcggcagagccggaaataaagtgccgatcgtcgtttccgtcattgtaatataagtaactgctccgacacctgcaataatgccggcgaaggctccttgctttgtcaccatattatgcttgaacaggctgaacaaaagggcggggaatagctgtgtgacaaggctgtagcccatcaaaagcaacgtaacgatggtattcccgcctttgaaggtaaaatacaccgaaatcaacgcaatcaccggcactaaaaacttagcaagagccgatacctgttgttctgtcgtgcggggcgcaattaccttgtacacattttttgcaaacagcgtggaggcggacattaagatcatagaccctggcacaagtgctgtcagcagtccggcagcaccgataattccgacaaaccaagggtcaaatgcttgcagagacagtttcaaaagcgacaaatccccgtctgcgcctttcagatctggaacttgcaggatagccgcgaagccgacgaaaaggacgaagagcaggaccagctggtacaaaggcatgatgatggcgtttttacgaaacacttttgggttttcggctgaatacgaagcggaaaacgtgtgaggccacatgtaaaacccgagcgctgtcaagagtacggttgaactgaaccaggccacactttgtcccgattcgggtagcgtaagaaagccaggctttgccgtttcaatctgctgaaacatgtcttgaaatccgccgtagtaatgaattggcaaatacacacctaaaaacagaacgacaaccagaatcatgatgtccttcacaaccgatatccaggcagacccgtgaatgcctgaaaccataacataaaccgtgatggaaacagcgccgatccagatggcggcggtcggggtgattttgccgtacgaggtttccgatacaatcagcccgaggcctttcagctgcagtacaagatagggaatgagtgcggcgatgccgaccagtgaaacgagaatgccaagcagcggactgttgtatttttttgtgaaaaaatcagactgcgacatcagtttatgctgtttcgcgtacgtccaaactgctggaagaagccagtaagaaaggatgtaggccagacatccgtaggcgatgatataaaaggctggaccgccttttccgtaggcccagccgctgccgccgagaaacgtaaaagtagtataaatttcgcctgccatcaaaaggaagacgaaaacagttccgaagccgcgccctccgaccgtccactgctccaggttcatgtcttttcctttttgggcgcgtataccgagaaaaatactcaagagcaggacaccgaagatgatgatgagagctgcattcattttgcttcctcctttttattttccttgtcgaggacatacacaatcgccatcagcgcagaggtcaaaagagcccacatcacaatataggcaagaataaacggcatgccgaacacatagggggtcaccttatttgcaaaagggatgccgagtaagattccgataaagggcaaagcggcaagaacgtgaatcagtttcatagaatcctccttctatttaggattggggtgtacaagcctaagcgtactgaaaatgatgtcgcagatatggcagcgcatgtcactttttagggtgaaaggctgtggttcgaattataaataaatttattttgtttgtatagtgtgaattgtctgaaattaatgctctgaatcgcccgaagagggaacgggcagtatgattcaaaaggctcggagtctgtccggggcaaatagatagtatgttaataattcgctgacctgctcacggattcgcggattaaaatagcgatggttttcttcataaccgtcgatgacaaatgtatagagcgtaaaggcctcatcgcgttccgtctcgcggattgcaatttttcttttcctcagttcttttctgacctccatcaaatccttttgtgctatttttaatgattcgccgataagctgtttataaggatgcttcaattttaatgtgctttcttcaattccggcgagatcacggttaaaaatcgtaatggccatgggcaaaaagagagcccgttcaattaaatcgtatatttcctcctgcagatttggcatattgactccttctttctaagggaacgtttgttctatttgtattctatatcggctggtgaaatgtttcaagacagaaaaaatcaccaaaactttttagttttctgctgataatgtgtagaataaggatagacaaacccggtaaggagtataaatgttggagcattttttatcctatttgacacaagaacatttaactgaattatttcaaagctatagggctttcggtccgctcatagctgtgctgctgcctttaattgaagcatttctcccgtttttgccgctgatcgtgtttgtggtggcgaatacgaactcgtttggcttgtgggaaggattcatcctgtcttgggcgggatcaactgctggttccattctcgtatttttgattgtccgtcaatacggacagagaaaattgcttggatttatccgcagtcatccgtctgtaagaaagctgatgttatgggtggaaaggcacggcttcggtcccatgtttcttctgctttgttttccatttacaccgtcagccgcggtgaatgtggttgctggtttgtcaaggatcggaacgcggccgtttattttggcggcagcctcgggaagcttgtcatgatttttatgatcagcttcatcggatatgatctgcacgcgctgattacacagccgattcgaacggtcatcgccgtattggtgatcactgtcttatggtatgtcggcaaaaaggtggagcggtatctgcatgtaagagccagtcagcgtgagcatgatggagggagacagtaacatgaaaaaacggttttggtttcttgccggtgtagtgtccgttgttctcgccattcaggttaaaaatgctgtctttattgattacaaggtagaaggcgtcagtatgaacccgaccttccaggaaggaaacgaattgttggtcaataaattttcgcatcgatttaaaaccatccatcgttttgacatcgtcctttttaaaggccctgatcataaagtgctgattaaacgggtaatcggcttgcccggtgaaacgatcaaatataaagatgatcagctgtatgtgaacggaaagcaggttgctgagccatttttgaagcatttgaaatctgtttctgccggcagccatgtaacgggtgatttttctttgaaagatgtgacgggaacaagcaaggtgccgaaaggaaaatattttgtcgttggagataatcgcatatacagcttcgacagccggcattttggtccgataagagaaaaaatattgtcggtgtgatttctgatgccgaataaaaagacgctaatggaagaggcgtctttttgtatgccgtttggaaaaatgtgttgaagaaaaatttgcaaggagctataatcaaaattgttacctgtgtaacaaaatttatatattttttgattggagggccgtttttattggtttttgttcgtttttcatgaaacaaaaggagtggtgaatgatgatgaaatatgaagcagtgattataggaggaggaccggttggatttatgctggcttctgagcttgcgatggccggagtgggaacatgtgtgattgaacggcttgaaaaacctgttccgcattccaaggcgttgacgctgcatccccgaacgctggagctccttgagatgagagggattttagagcggttcgtatccaagggaagcaagataccttccggacatttttcaatgctggatacccgtctggatttttcaggcttggatacgagctgtccttacacgcttttgctcccgcagtccaaaacagaaaagctgcttgaagatcatgcacgaaggctgggaacagaggtgtttcggggtgcagaggcgctgtcggttacgcaaaacggggaagcggtccaaacgatttttaaggatcgggacggcagtgtacggacgatcacaagcaagtttgccgttggggcagatggcgccgggagtaccgtccggaaacaggcaaaaattgagtttccgggaacagacagcactgtcaccgctgcgcttggggatgtggcgctcctttctccgccgccgtcaggcgtgctgtccctttgcacaaaagagggcggtgttatgattgttccgttatctccagaccgataccgtgtcgttgtgatcagtccttatcgcacgcaaacgccgaaagatgtgcctgtgactgaggaagagctgaaagctgacctcctgcgaatttgcggaactgactttggtttaagcgatccttcgtggatgtcgcggttcgggaacgccgcgcgccaagcgaaacggtatcgggacggcagaatctttcttgcgggtgatgccgcgcatattcattttccagcgggcgggcaagggctgaatgtcggccttcaggatgcaatgaaccttgggtggaaactggcggcggccatcaaaggctctgcgccttcatggcttttggacagctaccatgacgagcggcacccggcagctgaagggctcctcagaaacacggaggcacagacaaagctgatcgatttcactcaagcaggcctccatttgcgaagcatgatgtcggagctgctggccttccctgatgtgaatcgatatgtagcagggcaaatttctgcactcgatgtcagatatgaagctgatcgtaccatgccgccgaatcgtttgaacggggcaaggctccctgacatgaagctgattctttccgacggcaattcggaacggctgtacagctttctccaaaacgggacattcgttttgctgtcattgaggcaggaagctgatgatcatatcgaagtgaaaggcttacgtatggtaaccgcctcgcttgcagaaccgaatgaaaagttgcgggatgtgcataccatattgattcgtcccgatggacatgtagcctgggcggtggatgcatcagcgcccgattgttccgaggtgattcaaaaagggatcagccgctggttttccgtcaccagccgagtataattcaattcgattgtttcatctgtaacaaaacggtatgatagaagaaacaatcgaatgaaaaaggatggaaaacccgatgaacacagatcatacgaaacgcaatctttttgaattgtatgcggagctcattcatcaacaggagaaatgggaggggcttattaaagcctttttatctgacgaattgaggaagctggatgtagagcacgggagtaaatctcaattgacgatgacagaaattcatgttctatcctgtgtcggggacaatgaaccaattaatgtcacgtcgatagcagaaaaaatgaatacgacaaaagcgactgtatcacgcatcagcacaaaattgctcggcgcaggcttccttcacagaacacagcttagcgataataaaaaggaggtctacttccgattgacgcctgctggaaaaaagctgcacagtttgcacaaatattatcatcagaaggctgaacagcgttttctgtcattttttgaccgctataccgaggaagagattctttttgcggaacggctgtttcgggatctggtgacaaaatggtatccgtcgtcagaagaaattgaagggggcttcctagcatttttaaataaaaaacacgcactgcggtgcgtgtttttcgcttttttctatctttttcaaggctgtaacgtaaatcagatttcctcttgaagaatgaaattcaagatgttcaggaatttgcactgcttatacgatatgtctattagtatctttattttatacgttttttactgtgtttttgatgctttgttttcaagggaaatagggtcttctgttttagttctcctaatctttacagaaatacctactagaatgaccgccatagttgtaaatattcccatggttaataagatcgtatcctgatttaaactccatccaattaagaaagagatgatcgctcctccgaaacttgccgaggcaataaataaacttgtaacttcgtcaacgtacttctgaataatgattgatgctagtgttaaagcaatgggaaatatccccgctatacttaggccaatcaaaaatgtaccactcaattgaagtaatgggttacttatataagagaaggcaatcaacaaaacaattaaacaactacagctaaaaaggaggtatttggaaaaatcaagccttctacttacgaaaccaatcaatattcttcctatgatgatccctacccagaaaaaggagacacttataagactaatttgttcattgtcttggtttatcatgattgaaggtaaaaagttggcaaaatttgtttcgattccagcatataggaaagcaaaaaatacaaaaaagcctaattgctttgatttttttctatctcctataaagtattgaaatgctcctccgtctggaaaggtcacttgttggttagcattcttagcgtactttcggttcttggacaagaaaattaaccaccctacgaataggacgaataaaaaggtgaatatacagtaatacggtaaaaaccagttattgatatctatgaaggaattaattaataatgggaaagataaagcgcctaatccaaagagaacttccagcttactcattttttctgcattactttcgaaattagcaataacaaatgaaccaactgtcgtttctaatgtgcctgccccatatcctaagagaaaagccattacaacaatataataccaatccttagttagaaaaaagatacttaacgctacaagcattattgtcaaagctaaagtaagtgtcctaaaatgactgtatttcttaatcattaacggtgcgattaatactccgcttagaaatccggtaaactggaagaagattatgaccgaaatatcatctgttgtcttgttaaaagcctctaataaaaatggtgtcaaactccctgttgatatatggataatacctactgtaaaaaagaaagcatatccaaataaatatgtccctcttaacattcattacacccctatatgaaaaagcaggaaagtaaattcctgcttttttagtaacttctctctttgaaatactagttgactgctgaaacagacattggttgagagttgctgtctttctcaaagaacatttctaacacttcctgagatctaaaaccatcactaaaagaagggatctcaacccaatcattctgagttgatgcaatccaattgattaactcgcttctaaaagaatcagcccatccataaaactcgtttggcggatcgtttaataggctttgcggtactgggcagtctaccacgttcaagccatctatgagcttgtaaacgtgaggattacctgtgtggtatttaaactcttttttgtgtccaactacctcaatgctaaaaccacagtcttcaggtgcagaacactttgatgtgatgatatttacaaataccttgttcttcagctggccataaatttctgcatagtcatctactagtacctgtttatcctcttttgtttttacatttgtgttcatttttgcccttactgattctgtgatgaaatcactctcgaacaaataccataccatgtcaataaggtgaatacccagatcccccaatgatccactcgtcttcctactgttagcgtcatctctccaagtaaacttcttacgtctaagtgcactatttttcttgaagtgtacttttatggacaggatgttacctaattcattattgataattaagctttttaagatatttacgtaagataaatatctataattaaatcccatactggctcttacgctcaacctttcagcagtatctttcattatgcttgcttcttcaagggaaatagccataggcttttcacacaaaacatgcttatgttttcctaatgcttgcaaagcatgttctttatggcaatagtttggtgatgctacaattaaaccttctgaggcatcaattagttcatctacgttttcaaatgacttcccgccgaaagttttcacaaagctttccgcattttgttgatttatgtcatatacccctactaactctgcattttttattgtagataaagcagttgcatgcgctcttgcaataccacctgcacctatgatgccaatcttcttcatttttatttcctcctcatgatccaattaatttttttaaggtattagtaattccttttgagtactcactatcagttataaggttgtgcaagtttttggcttcctgtgttgcattttttagcagatatccattccctactgtctgtaacatacgaacatcatttccactatctccaaatgcgatagctctttcggtatttaggttgtatttctctaacataaacgttacaatttcattctttcctgtccctatggggataaaatctacatcatagctgtcttctggatcgcctgctaagggattacaccgatttatatttactgaaacgccatattcttcgcagattttttcaattgctaataggtttttcttgtcgtttatttcatcttgttcctgatagtagaagttatgcttataccgtgactttcctaattgagtttgaggattcaaaagaatgttatgattttcatgcagctgtttcacaagtttttcaaccttttctttactaaacccttcatttatgcgactgttccacttgttatcttgctgaccgaagttatgctctgaaaagtacgtaatttcagttccaagatcactagctataaaatgcggaaaatatctaaattttcctcgtcccattttatcgataatagattctatactgctcccagtaacccatccgattattagttccccatctttacttttttgttctaggtagtcttcgagttcataaatgtcttgttgtttttgttcgtcgattgtatgcggaaaatacgtttcatcaaaatcacaaaaaacaatatactgaggatgttcaaccgtggataacgttttatactccgatttcttgcttaataacatgaaacagtccctccattactctgtcttgttcttctaaagtaaatgacggatataaaggcaaatgcagtacctgactatgagccttttccgtatgaaccaatgggagtcctgcatacttgtcctgtactaaaggagttttttgcatatgagacagtattggataatatacatctgtttgaacaccaaaatcttcatttaatttagtcatgatatctgctctatcttctgttctcaccttaataggaaacagatgccatacatgatcttcacttaattctggtaattcaataaagcctttattctgcaactctgctaattgggtaatgtatctatccgccaagaacagtcttttgaagttgtttaatgaaaggtacttcattctctctaaaccaattgctgcctgtaaattgtccatttttgaattaaatccaaaattgatgactttcttatttttcacatttacttcaaaaccatgataactaaattgaatgcattttttagcgagttcttcattatcagttgctattgccccagccttgccacatacaccaaaattcttatagggattaaaacttaatgtagtgatgtctgcatactttcctaagtctgtcagtccaattccttggcaggcatcttcaattacttttaatttataacgatttgcgatttgacggatatgctgcatgtctgaatgttttccgtataaatgcacaggtagaataaactttgtataagaagttattgcttcttcaattttgtcaggatcgatgcagaatgtttgtgggttaatatctacatagataggaacgcctcccaaagctaacacagcattttcagtagctgaaaagctattagccggcatgataacttcatcccctgggtttaaccctaaagccaataaacctatcataatagcatcggttccactgctggttgcaattacataccttttatgtaaatatgtagataaaacgttttcgaattgctctaaatagggaccactcgtaaattttccagttggcaaaacttcagttaatgtatttaagatatcttccacttcatcattggttattaatctgtctacaggcaaaaaagggactttactgatttcacgatttttttgatagttgaaaagatcatgttcaatatctatcttttcctttaatacttgtttccaccgctcgtttacaatactgtcttcaataacaagttcttttccttgtacgtcaccttttaagtgttttaatagtgacatgttttctttgcttttacctgaaatcttaacctgtttttgcatgaacagtacctccaatgattttataatctaaaaatttattacaaatttatcctaatttctgaaatcggtaacatgtcaacaacttttttaaggaagggaaaatatgcctacaattgatgaaatagcaaaattatgcaatgtgtctaaaaccacagtgtcaagagtattgaataatcatccgtatgtgtcgaaagaaaaaagagatatgatcttaaaggcaattaacgaacttgactacactcccaattatttagctcggaattttaggagaaataagacacaaacgatagctttatcggttccgagtattgaccatccattttttgctcaattaataaaaggggtctcacatgaagcactgtttaagaattacaaggtaattgtatttcagaccttttatgacaaacagacagagctagaattgttagagttattgaagcataaagaagtggatggtattattcttggaactttagaaaatgaatgggatcagatatcccctttcttaaagtatggtcctatcttattatgtaatgaatatcatcactcagcggacatcacgataattgggtatgatgaatttgaagctacatacatgggggtagtacatttaattgaaagagggcataaaaaaattgggttttgttttgatactccatatagcgaagctcaatgtcagaggaaagagggttatttgaaagctttacaagattacgatttacatcatagaagcgaatggatattcggcgaaatgtttaatatcgaggatggctttcgtgtttttcataagataaaggatctaaaggacagaccctcagcaatatttacaggaaatgatcaagtcgccgcagggattattaaacaggcgatgaaaaatggctttaaagttccagaagacttagctgtaattggttttgacaaccaattgatctgccaagtcgttactccgaccataacaacaattgatatccccgtaatagaattaggtcaacaggctgtattgaaaatcatcgagtccatttcgggtaatgccactttaaacagaagaattattaaactgccaacaaagcttattataagagaatcaacgtaacgatagatttccctttatcattttatatctttatataagaaaaagaggttattcattttaacctctttttcaatcgtaagtcgtcaattatttctttcatttcaccctctggcagcattcacttcaaacctgatccattaacaacgaaatatccgcttatatttcctcatctcgatggtttgcgaattaaaagttcttgaacccttttttcaactaggcactactgccgctgattgagctctttttgtcttttttttcaccatgaagatggtgaagcaggcgataaaacggcggcagcagggcaataaccagaataacgcgaatgacctgaaccgcaacgacaaaggtggaatcagcatgtaaggtaacagacgtcgtcgccatctctgcaatcccgccgggcgcaaatgccagaacagaagtgatgagcgaaattcctgtcagctcggaaacgatcacggcgctcaaaaacattgctgcgattaaaccgacggaagagacaaacccgacgatgataatacgggtgacgccggcaaacatgcttttgtacatcttagagccgatcgttgccccgagaaatacttgtgatacatggttagcttgtgacggccaccatgccatcatgtcgtgccctgtcaccgcagctccgccaacatgtacaattgctacaccgagcatgctgccgagcagccatggagctggaaattttaaaaatttcgcagctttgcaagctccccaggcagcgagaataagaatgacggtccacaaaacgggagcgagcctaaaatctgtcgttgcagaagaaattgtctctgctgcggcacttgcggtacgatcttgttttgtatagatcagaatgactaaaaacggaatggaaagcaccacgagcagcacacgcatcatttgaacgaggctgactatagcggtattggcgcctacttcctgtgcgatgctcggcatggcggaaagtccgccgggagcggtgccgacaaagctggtcatcatatccgttttgctgaaacgccaaagcacatatcctgacagcatggccagcaggatagacaatatcagcataacgccgactgaaaaccaatggtctttgagaacagagagaacggataaattcagcttttggcccaattcgatgccgaggatcatctgcccgagggcgagccatcgtcggttaattcctttttggtctggtgccatcatcagccatgccggccgtatcatggcgaggcagcaggcgacaatcagtgttccgatcatccatccaattgatattccggttaatgaaagaataaacccccggctgcactgattgcgataaaccatagatctttgaggagattttcgtctttcttcaatgtaaaacccttcttcctttttcacgtaacactccaattgttcacgtagtgaatgtatttattactatagtatatttttgttgataaagaaattatgaattattttctataagcgattcgcttttcttatgaccttgtgttcgagcttttctattgtgtaagtcagagataaacccgctgtcagcagacacacggcaagagcgtaaaaaatcacttctccgccaaatgatgtcaggatcagcccgcctgccagcggtccgattgagcgggatatatcccaatgcagaccatagacagcataaaaccggcccagcaaatgaggcggcgccaatttcgatatgaaggtctggatgtgggttagcccgatgctttcgccaaccgtcatcaccgctgccgtcactaaaagcattgtcagggaggttgagcaagcaaaaccggcagccgcaagggagtagcaaatataagtaatgaaaaggattgttttcattgaaagcttttcggtccctttgacaagaggtacttggagaacacagctgaataaagcttttgctgctgaatagatggtcagcatggacagataatcagaaaacatgtttttgctgaacagcctgtatgttgtttctgtttgtgcatataacatgcttatggggagagaaagcagcaaaagaagcaggacaggcctgtatatcataaagctcgcagacattttcggggtaacagctgggtgtagcggctttgtctcaggcagtttcagtgcagcgatcagaaagtagataaacaatgccgcagcatctaatgcgaatatccacacggggttatgattgtaaagaagcatccccactagcggccctgccgtcagacccgccgaatagatcgcattgatgaccgcaaacacttccgaacgtctgctttccggcgtgctttcagcgatttgggcgcgggaagcgggaatgtacaacgatcttccgatgccattcatgacatagagaatagcgaaaacatacgcatgctcagcaaatacaaaccctgtcattgccgctgattgaagaagcaatgcggtcaaaatcgctgtgcgccgcccaatccggtccgccgcctttcctgcagcgagcgtcaggaaaatatcagcaaatggctgaaggctgatgatcagcattggcatcatgatactgccgtttaattgttcatgcagatacagcaccataaaaggtcccatcattgcacctgtcaggcttgtcagcaattcgccgaaaaagcggagccgaacgggagcggtatatctcgattttatagagtgaaaactggtcaacatgtgatcgccgcctttcgctgtttgatatagtagtagtgtatagaaggggcggcggcccaaaaagtgaagaaaagaagagataaaagttccccttttgtcgggaggtgcggggattgaagctgatagagcactacgtggcgcttgtaaaaacaggctgcgccgagtatgggcaaatgaacgaaatgacgctcactgagattgccgactgtttatgttgtacagaaagaaatgcaaagctcattttacataagctggagaacagcaattggattatccggaaaagcggggcggggcgcggccgcaaatctaaaatcgcgtttcttcggaggcctgaggaactgcttcttcaaactgcaaaggaatataccatgtcaggaaagcttaaaaaggcaaaggagctgcttcagcagtatcagtccgcgtttccggggcttcaaaacgaatataacatgtggctttcagaggtattcggatttgtgacggagacaggcgagaatggggcgaaggatgttctgcggctgttcatcacgcccgaatctgtcagcagtttggatccatgccaaatatttttgcggtctgagggccatttcgtcaaacagatatttgatacactcttcacgtttgattcggatatgcaggagccgaagcctcatttggttcatggatgggaagaggtcgaaaaaaaacaatggagattttttcttcgaaaaggtgtgtcatttcataatggacagccgctgacatcgcgggacgttgcgtttacgtttcagcgctttttggaactgggtgacaacccgtataaatggcttctgcacggagtgaaacaagtcttagaaaagggcccttattgtgtggcgctcatactcgataggccgaatgcgcttttgccgtatgctctttgtgatgaacggctgtccatactgcaggcagaacagggcggcgggaaaaatggaacagggccttttcaggtgaatcagcaacacagcgggatgcttgtgcttgaagccaatgagcgctacttcaagggacgcccctatttggatcgcgttgagtttgtgttttctgagcaagccggagagatgaacggttttaccattcaagaaaaacaaacatgtcctgagcagcaaactgtttttgatgagcggcatgttcagtatttgtcgctcaatctgaaaaagaaggggcctcttcagcaccaaagctttagaaaagcgctccggctgctgatttcctctgaacggctcgttcgtgaagcgggagggcaccgaagaatcccggttacgtcctttttgcatccgagttcttttgagtgggagggcgtttcgccatctgaattgttgaagaaaagcggttacgagggcgaaacaatcgtgctttataccttttcggaaacggatcatcgtgaggacgccgaatggattcaaaatatttgcgcccagcacggtatcaggcttacacttcaattctgtgatgctgctgatctgcgacggccggaaaccgtgcagatggcggatatcattcatgacagtgcgacgttttatcaagacagcgagtttggttttctgcatttgctgctgtcggagaacagtttcttgtatcagcatctatctgaaaagctgacacagatttgctcaggaatgatagagcggatgttttccatgcctgatcgctgttcgagaatcaacatcctgcgtgacattgaccggcagatgatacaggagctgaacgcgatcccactgtatcaaaatgtgctccaggtgacatcaagtaaaaatgtaaaaggcctggtgcttgatgaagagggatggattgatttgaactccgtatggctgtccaaataaaaagagggttcttttttgaaccctcttttttacgctgccatgctgcggcattgttcagcacaggtgaagcaggctttcgcacatgcttggcaatgatcatgatcgtgctttccgcattcagtgccgcatgcttcacaaatatcggcgcaaagtgcaaaaatttctttcataaacgggctgtccgtttgcatggctttgaccgccagcgcgcaaatatccgcgcattccctgtcaagccggatgcagccgctgagatgatgctgcacgctttcttccaagcatttagtgaaacaatgattgcaagccttcatacaatcgatgcaagcctcaatacaagcttcagaatattgctccatggttgattccccctgtatgacagtatatggttttatgtttcccggctgcatttgaaaaaaacaggggagtgtgtttttagctaaggggatatgtacatataccctgaatgggtatatctaacgttccatcagatagtataggaaccagacagcgtgattttgttcatcacgtgctgcgcgcgtaaagacgcctttcgcttttaggtttgacgtttcctcggccgcacgcaagtaaaagtcgacggtttcttgttcatctttaaaagcggcgtccagtcctcttgtgaaattgtccgggcattcttccgtttgtttcggcatgatgtgtttgccggtaattgaaccatacagtgtggaaaattcacggaggtggcgaatctcgtcacgcctgatttcttcaatctgttttctgacctcatcgctgtgggcgagttcggcaagcttgcggtagcattgaatggcactgaattctccgttgatggccttctgcaaattccgaatcaaaacaggatcttccctgtatggcaccggatagggatagtagctgtaatgcaaggggattcaactccattcttaggaattgggcttctgtaaaagtatatgttgggcagggagagatgtgcggagataatcagctttttatatgtgaaaaggccgtttttaccaatagatcagattggtcattttcgtcaacattcgataaaatatatagagataaaaagagaggggtcttctaatttgggagcagagtttttagtaggcaggtccgggagtggaaaaacgaagctgatcatcgacagcattcaggatgaattgcgccgggctccattcgggaagccgatcatttttctagtcccggatcaaatgacgtttttaatggaatacgagcttgctaaaacgccagatatgggcgggatgatacgcgctcaagtgttcagtttttcacgattggcctggcgcatcctccagcatacgggaggaatgagcaggccgtttctgacgagcaccggcgtacaaatgctcctgcggaagctcattgaggagcataaacaggagttcaaagtctatcaaaaagcgagtgacaaaagcgggtttaccgcacaggttgagcggatgctgacagagtttaagcgctattgtctggaaccggaggatatccgccggatggcggaaagcggaacggcttccgagtatcgcggagaacgtgttttatctgaaaagctccatgacttatcaattctgtatcagcaaatggaaaaaagcctcgcagaccaatatcttcactctgaggattatttgacattgctggcagagcatatcccgcttgcggaagatataaaaggcgcccatatctatgtggatggcttttatcagtttacaccgcaggaattcagggtgttggagcagcttatggttcatgcggagcatatcacgttttcgctcacagcggacaagccgtcatatgagcgggagccgcatgaactggaattgttcagaatgacggggaaaacctattaccgcctgcatcagaaggcgaaggaactgaatttggacattacgtataaagagctgagcgggactgagcggcatacaaagacgccggaattggcgcatctagaggcacagtatgaagcgcgtccggccattccatacgcagaaaaacaagaagcccttactgtgatgcaggccgcaaacagacgagctgagctggaaggcattgcccgggaaattcacgccctagtcagagagaagggatatcgctataaggatgtagccattcttgcgcgccagccggaagactacaaggatatggtgaaggaagttttcgcagattacgagattccttatttcattgacggaaaagcatctatgctgaaccatccgttaattgaatttatccggtcaagccttgatgttctgaaagggaattggcgttatgaagcggtgtttcgctgcgtgaaaaccgaactgctattcccgctcaatgaaccgaaggccaaagtgagagaacaggtcgatcagctcgaaaattactgtatcgcctatggtattaaaggcgaccgctggacaaagggcgatcggttccaatacaggcgttttgtgtcattggatgatgattttgcgcagacagatcaggaaatcgaaatggaaaacatgttgaatgacacccgcgattggattgttccgccgctttttcagcttcaaaaacgcatgaaaaaagcgaagacggttcaagagaaggcggaggcgctctatcgttatttagaagagacggatgtgccgctgaagctggatcaggaaaggcagcgtgctgaggatgacggcagaatcattgaagcgcagcagcatcagcaggcgtgggacgcagtcattcagctgcttgaggagtttgttgaaatgatgggagatgatgagatttctcttgatttgtttcagcaaatgatagaagccggcgcggagtcgcttacattttctctaattccgcctgcgcttgaccaggtgtttgtcggcaatatggatttgtccagaatgtatggcacctcctgcacctttgtgctcggggcaaacgacggcgttctgccggcacgccctgatgaaaacggagtcctgtcggatgatgaccgggaatggctgaaaacgattggggttgagctatcctcaggcggacgggagcgtttgcttgatgagcatttcctcatctacatggcattttcaagtccgtctgaccggctttacgtatcgtatccgattgctgatgcggaaggaaaaacgcttttgccgtcgatgatcgttaagcggctggaagaactgtttccatatcataaggagcgcctgttaacaaatgaacctgaacaggtcagcgatgaggaacagctgatgtatgtcgtgaatcaaagcgtggcacagtcctttaccgcgagccagctcaggttatggacacgggaatacgacatcagcgacgtctggtggagcacgtacaatgtgctgatgagtgagccggacaggctgcagtcgaaaaagctgttctcaagcctgtttttccggaatgaagtgaagcagcttgaacgcagcgtgtcgagacagctctatggtgaacgcattcagggcagtgtatcgagaatggaaacctttaacgcatgcccgttttcccattttgcgtcacacgggctgcatttgaaggaacggcaattcttcaagcttgaagcaccggatatcggccagctgtttcattccagcttaaagctgatttctgacaggctgcgtgagcaaaagctggattggcgcgatttaacgaaagagcaatgcgagctgttttcctatgatgcggtagagcggctggcaccgaaactgcaaaaggaaattctgctcagctcaaaccggcattattatgtgaaggaaaaactgcaaaaaattgtgacacgtgtatccggcattttaagcgagcatgcgaaagcgagcggattcgtaccgatcgggcttgaactgggctttggaggaaaagggccgcttccgccgctgacctttcaactgaaaaacggctgtacgatggaactcgtcgggcgaattgaccgtgttgataaggctgaaagctcaaaaggcctgctcctcaggattgtcgattataaatcaagcgacaaaggccttgacttagcggaagtatattacggattggcactgcaaatgctgacgtaccttgatttatcgattacacattcagctgactggctcgggatgagggcgacgcctgccggagtgctgtatttccatattcatgacccgatgattcaatctaatctcccgcttgggcttgacgagattgaacaggagatctttaagaaatttaaaatgaagggcttgctcctcggtgatcaggaagtggttcgcctcatggatacaacccttcaagagggacgttcaaatatcataaacgccggcttgaaaaaagacggatctcttagatcagactcggccgcagtcggtgaaaaggaatttgatcttttgacaaagcatgtgcgccgcaccttccaggaagcgggcgaacaaatcaccgacggacgcgtatccattgagccgtacaaaatgaagaacaagacgccgtgcacatactgtgcgttcaaatcagtatgccaatttgatgaatcactggaagaaaacgagtatcgcccattaaaggctgaaaaggacaagacgatacttgagtggataaaaaaggaggcggatggcaatgaacattcctaaaccggtagacagcacatggacagatgaccaatggaatgccattgtttcaaccggccaggatattcttgtggcagcggctgcgggctctggtaaaaccgctgtgctcgttgaacgaatgattcggaaaatcaccgcggaggaaaacccaatagatgtagaccgtcttctcgttgtgacatttacaaacgcctcagcggcagagatgaagcaccgaatcgcagaagccttggaaaaagagcttgtacagcgccccggctcgctgcatatcagacgccagctgtctcttttaaaccgggccagcatttcgacgcttcattccttttgcctgcaagtgctgaagaaatattactacttgatcgatcttgatccgggctttcggatagctgatcagacggaaggcgagctgctcggtgatgaagtgcttgacgagctgtttgaagacgaatatgcaaagggtgaaaaggcattttttgagcttgttgaccgctatacgacagaccggcacgatctggatctgcaatttctcgttaaacaggtgtacgagtattcccgatcccatcccaacccggaggcgtggctggaaagttttgttcatttgtatgatgtatcagaaaagagcgccatcgaggagctgccattttatcaatatgtcaaagaagatattgcaatggtgcttaacggggcgaaggaaaagctcttgcgcgcgcttgagctgacgaaagcgccgggcggcccggcgccgcgtgctgacaattttcttgatgatcttgcgcagattgatgaactgattcagcatcaggacgatttcagtgaactatataagcgggtgcccgccgtctcttttaagcgtgccaaagcagtaaaagggatgagttcgatccagcgctccttgatgaggcgacagatttgagaaacggtgcaaaaaaactgcttgaaaagctcaaaaacgactacttcacgcgaagtcctgaacagcacttgaaaagcctagccgagatgaagcctgtcattgaaacgctcgtacagcttgtcatcagctatggaaaacgattcgaagctgcgaaacaggaaaaatcaatcattgatttttctgatttggagcattactgtttagcgattttgacagctgagaatgacaaaggtgaacgtgggccgagcgaggctgcgaggttttatcaggaacagtttcatgaggtgctcgttgacgaatatcaggataccaacctcgtgcaggaatcgattctgcagctcgtcacaagcgggccggaggagactggtaacctgtttatggtaggagatgtcaaacagtcgatttatcgattcaggcttgccgagccgcttcttttcctctctaaatacaaacggtttacagagagcggagaaggcacggggcggaaaatcgatttaaataaaaatttccgaagccgggctgatattttagacagcacaaactttttatttaaacagctgatgggcggcaaaatcggtgaggtcgattatgacgagcaggctgagctgaagcttggtgcagcgtatccggacaatgacgagacggaaacagagctgctgctgatcgacaacgcagaagatacggatgcaagcgaggaagcagaagagcttgaaacggtgcagtttgaggcaaaagccatcgctaaggaaattcgtaagctgatttcatcgccgtttaaggtgtatgacggaaaaaagaaaacacatcgcaatattcaataccgagatatcgtgattttgctccgttcgatgccgtgggctccgcaaatcatggaggagctgagagcacagggcataccggtttacgccaatttaacgtcaggctatttcgaagcggtcgaagtcgccgtcgcgctttctgtgctgaaggtaatcgataatccgtatcaggatataccgcttgcctctgtgctgcgctcaccgattgtcggagcagatgaaaacgagctgtctttgatccggcttgaaaataaaaaagcgccgtactatgaggcgatgaaagactacctggctgctggtgaccggaacgatgagctttatcaaaagctaaatacgttttacggacatctgcaaaaatggcgcgcgttttcgaaaaaccactcagtatctgagctgatttgggaagtgtaccgcgacaccaaatatatggattatgtcggcggcatgccgggcggaaaacagcgccaggccaatttgcgtgttctttatgacagggcgcgtcaatatgaatcaacggcatttcgcggcttgttccgtttcctgcggtttatcgaacgcatgcaggagcggggcgatgatcttggtacggcgagagcgctcagcgagcaggaggatgttgtccgcttaatgacgatccacagcagcaaagggctcgaatttccagtcgtgtttgcagcaggtctcggccggaatttcaacatgatggatttaaataaatcgtacctgctggataaggagctcggatttggcacgaagtatattcatccgcaattacgcatcagctatccgacacttccgctcattgcgatgaagaaaaaaatgcgcagggagctgctgtcagaggaattgcgtgtgctctatgttgcattaacgagagcgaaggaaaagctgtttctgattggctcatgtaaggatcatcagaaacagcttgcaaaatggcaggcatccgcgtcccaaactgattggcttctgccggaatttgaccgctatcaggcgaaaacgtatctagatttcatcggcccggctcttgccaggcacagagacttgggggatttggctggtgtgccagcacacgctgacatctcagatcacccggctcgttttgccgttcaaatgatccattcctatgatttgcttgatgatgatctggaagaaagaatggaagaaaaaagcgagcgcctagaagcgatccgccgaggtgaaccagttcccggctcgtttgcgtttgatgaaaaagcccgcgagcagctgagctggacatacccgcatcacgaggtgacgcaaattcggacaaagcaatcggtttctgagatcaaaagaaaaagagagtacgaggatgaatacagcggcagggccctgtaaaaccggctgatggaagcattctgtacagacgtcccgcttttatgatgaaaaaaggcctgacagcggcagagaaagggactgccatgcatacggttatgcagcatatcccgctgtcacatgtgccgtcgatagaagaagctgagcagacggttcacaggctttatgaaaaagagcttctcactgaagaacaaaaagacgctattgatatagaagaaatcgtgcaatttttccatacggaaatcggcggacagctgatcggcgcaaagtggaaggacagggaaataccattcagcttagcgcttccggccaaggagatctatcctgatgcacaggaggcagatgagccgcttttagtgcagggtatcattgactgtctctatgaaactgaggacggattatatctattggattataagtcggaccggattgagggcaaattccagcatggatttgaaggagcggccccgatcttgaagaaacgatatgaaacgcaaattcagctgtacacgaaggcagtggagcaaattgcaaaaacaaaggtaaagggatgtgcgctttatttctttgacggagggcacattctgacattatagcgagatccaaaagctccggaatttcaggcggagcgggtctcgttttctatataaaagagaggtgaaagcatttgcggattttacatacggctgactggcatcttggaaaaacgcttgaaggaagaagcaggctgagtgaacaggccgatgtgctggatgaaatgaatacgattgtaaaggatgagcagatcgatgccattgtaatggcgggggatgcatttgacaccgtaaacccgccagctttagccgagcagctgttttatgaaagcctgtctgcgcttagcgacagaggaaagcgcccgatcgtagtcattgccggaaaccacgataatcctgaccgtttgtccgccgcttcaccgctgacacatgaaaacggcattcatttaatcggttatccgacaacagagccgattcatattgaagtgccttcagcaggagagcttttggcggttggagcgctggcgtacccatctgaagcgcggttaaatgaagtgctatccgatacgtttgatgaaaagctgctccgtgatcactatgatgtgaaaatcaggcaggcgtttgagcatatgacaagccggttccggaacgatgcagtgaagattgccgccagccatatttatgtggcaggcggaaaccaaaccgattcagagcggccgattgaagtcggcggtgcatacacggtggctgctgaaagcctgccggcagatgctgcttacgttgcgctcggccatttgcatcgaccgcaaacgatcaagcgggcgcggacgcttgcgcgttattcaggatctccgctcgcctacagcttttctgaagcgggctacgctaaatcagtgacgattgtggacgcaaagcctggggaagaggccacttggcaagaggtgttattatcaagcggcaagccacttgtgaagtggaaagcggcaaatggattaagtgaggtgtacagctggctggatgaaggcagagatcagaatgcttggattgacttggaaatccgtgtcgcggaccagttgtcacttgaagagattcacaggctgcggaaggcgcacccgggctttatccatatcaggccggtttttgaagaacagaacaaagaccgggaacggatcgaggttaaacatgtctcaatcgaggaccgctttaagaaattttatgaaaaacaaactggcggtgcggtgccggatgaagaaatggtgaagctgtttttagagcttgcatcaggcgttgaagaggaggatgcgaaatgaagccgatcgccttaagcattaaggggctccacagctttagagaggagcagacgatagattttgaaggcctttccggtgctggtgttttcggcattttcggcccgacaggaagcggtaaatcctctattctcgacgcaatgacgcttgctttatacggaaaggtggaacgggcggcgaataatacgcacggtatcttaaaccaggcggaagatacgctgtctgtttcctttacctttgcgcttcagacgaatcaccaaatctcatacaaagtcgagcgtgtgtttaagagaacggatgaaatgaaggtaaaaacggcactttgccgcttcattgaaatcaaggacgagcatacggtgctggctgataaagccagcgaagtgaataaaagagttgaggaactcttagggctgacgatcgacgattttacgagagcggtggtgttgccccaagggaaatttgctgaatttctgtctttaaaaggggcagagcgcaggcatatgcttcagcgtttatttaatttggagcaatatggagacaggcttgtgaaaaagctgagacggcaggcgcaggaagccaatgcgagaaaaaatgaaatgcttgctgaacagtccggtctcggtgaggcgagctcagaggcagttgagcaggctaaaaaggctctcgaacaagctgaagcccggctggaagcgatgaggaagaaccgtgatcaggcgaaggagcggtttacagagcatcaggagatatggaatgtccaaaaggaaaaatccgcttatgaagaagaggaaaaacgtctcgcagaagaacagccgcatatagacagcatgcaaaaacgcctgctggaagcagaaacagcagcagctcttaagccctatgcggaccggtacgcagaagcgatccagcatgaggaacaagctgaaaaggaacaaacgctagcccaaaaggatttagcagaccggacagctttctttcagcaaaaacatgaagagtatgaagcgtggcgccagcataaaagcgagaaagagcctgagcttttaactgagcaggaacagctttcacgcttgcaggaaatcgaaatcaaactgagtgaggccaagcaagagaaagagcgcaaaaagactgaactccagcagaaagaagaggctcttcaatctgtcatgaatgaattggagacggtaacagaccgcctgacgcggggacaaaacagacagacagaattgaaacagcagctcaaatccctgcaggtgacatccaatgagcgaaaaagctgccatcaggccgcagaaatggtattgcgcatcagacaaaccgaggagcaaatcaaaaaagagaaaaaacgaagtgaagaattgaacctcgtgctgcagaagatgaatgaagagaagaatacactcgttcaaaagacggaagcggaagaaaacaacatcattcaggcatatgaggcagttcaaactgtgtatcatttggtgtgcgaaacggaacgctcattaacacgtatgacggaagaggctagaaagagtcaacacacgcttcacttacagcgtgaaaaagcaagggtggcactgctgacaaaagagttagcccaaaagctgactgccggaaagccttgcccggtatgcggttcaaccgatcatgatccatctgcctcagtacatgaaacatatgaagccgacagccatcttgaagaggacatcaaacggacagatatgttattgacggaagctgcagttctcagccaggagattctttccgccaaaattacgcttgaagaacagtccgcgcgctttattgaacagtgtccgtttttgcagacaattcaagcgcagaaccttgaagcggcagcttccttcgaacatcagccggtgtatgaagcatttgaaactgccaaattcgaatggaaacgaatcaagcaggacattctttctgttaagacacgaatggcacaaatgatcggcgcctatcaggagtctttaaaaaaggccgagcagcttaatgaaaaaatcggttttgaaaaaagagaagctgaccgtattgaaagcatcatcagcgagcttcaatcctcaatggacagcagtctgaacatgtttaaagaagcatttcagaatcaatctgtggacgaagcagaaaaatggcagcaagccattgaagaaaaggaccgggctgcagaagaatgtgaaaaacgaattgagaagagtatcgcgtttcttgctgagcatgaagcacaaaaggaaaaactgcgggaattgggacaccggcttgagcgggaaaagctggagcttcattatgcggctgaacgcatcaagagcgtgatagctgattatgagcacgaactcggagattatgcaaaaggagattcggttcaaatcaaactccgctctgtccagcaggatctaaagctgttaaaggaaaaagaacaatctttatatgaagaactgcaaagcgcccaaatgaagctcaaccaggcgaaaagccgcgcttcggcaagcgagctcactcttcaagaggcgaagggcagattggaaaaagcaaaagctgcttggcttgagcatacaaaaaacacctccattacccggactgaggaggttgaacaaagtctcatcccagctgatgaacttgaaaagatgaaaaccggcatagaccagtttatggataaactgaagcaaaatgctgcaaacttaaaacgagtagcagagatacttgccggcagagcattatcagagagcgaatggaacgaaaccgttgcagcattacaagaagctgaggacgcatttggcgctgctatagaggaaaaaggcgcggctgcaaaagcactggctgtcattcgcgaccatcataaacggtttaatgaaattgaagctgaactgaaaaaatggcagacgcatatcgacaggctggacaagctgcaagctgtgtttaaaggcaataccttcgtcgaatttttagctgaggagcagcttgaaagcgttgcgagggacgcctcagcaagactcagtatgctgacaagacagcgctatgccatcgaagtagattcagaaggcggcttcgtgatgcgggatgacgcgaatggaggcgtacgacgcccggtttccagtttgtctggaggagagaccttcctcacctcgctttcacttgctcttgcgctgtctgcgcagattcagcttcgggggaatacccgcttcagttctttttcttagacgaaggcttcggcacactggatcaagatctgcttgatacggttgtaacggctttagaaaaacttcagtcagacaatctggctgtcggtgtcatcagccatgtacaggaactgcgtgcacggcttccgaaaaagctgatcgtccatccggctgaaccgagcggccgcggtacgcgggtatcacttgagttgatgtaagggaggagcggatatggcaaagcagactgccggaatatgtgagctgtgcggccggagcgatgtccagctgacagagcatcatctcacaccgaaagaggaaggcggaacgtttttgccgacagcgatgctctgtattccttgtcataaacagattcatgccttatataccaatcaagaactcgctgtacgtttaaacaaaatggctgaactcagaagcgatccagagcttgcccggtttgtcaaatggatcagaaaacagccgcctgagaagctgatcaaaacaaagaaatcaaatgaacgaaaaaagaaaaaatgactaaaaagcagccctctctttgcagagcggctgcttttatccgtttccaaccatatcctgatcgttgacatcggggtctatataatttgtcgcgttgactgcattatttaatagaaggaaatctcccgtgtttcctgctcccgaaccgagcgcagattttgaagagcttttcggagaaaggtaaaaggaatcaccaaagtttacgactccgcccgatatggaattgatagctataggcccgacaattgctggcataaacgacaccctttatcgaagtctctgtttattatatgttcttggcgggcgattgtgagcgcggagactgaatctgtctgatatgtttgattcttgcatcaccgcggataagcgaagctgaaccagcatgtaaaacagaagaggcggacaccccttgaattttgatgctgcgaacataaatagccggcacctcgtggcaaaatgcgctttgtacacctgtttcgcgaatcggcttcactgcctgctgctgaaagatttggtactcctttttgttaaatgagccttcattatggtaaaacgtggaccgagaacgctgaacagcaaatacttttacactcatatcgatttcatttgtgtcgccaacttgaaacacacttgcgatcccgagggaattaaacttaactagtctgatgcgtgatatgcgtttaagcattattctggcgcaatcggagcaaacggcccgataataagagattcaggcggtgtatcaaaaatagaagacaggtagatggattcagtgtctccgatgtggaaaacggaggaactggacacaccgttcatccggatgtccccgacttccaagctgcggttgatgactgtaaagatcatgcttgctcatctcctttcatttctgatggaatatgctccagaaagtgttctacagcgcggatgacatcacgcttcacatgctcagcgatatgttctgcatattgtgcaggcggtgtattttcttcttttttgatatgggacatataatagtgaatccggctgtccatttgttttctgatgtcttcaataatatgatgtctgtttgtatcgtcaagtctgctgtcatattggttttcaagctgttccaaaatatctgggatttcctcggttaagtacatgtcgacattctggcggatttgctgcatgagctgagcgctctcttcctgctgcatcatcccgatttgcggtgtcgactggctgacttcaaagttttggacgctgtttgggtcagtcggatttaagccgatattcaaagttccgtcgagcctttcgattttcagctgatcaaatttatactccacacgctcaatggtagtggccggccgctgtttcatcgtattcatttcagtttgaatctctttcagctgacgttcgagctgctgaatgtgaatcgcctgctgctgaacgaaggaattcaagttttgcaggtaagaggaaacagattgatcatacatgttctttcacctctttcatatgattaacggccaggaggctggagcgggaccaatgaacctgtagaaggcccctgtaattcaactggctgccccgcggaggctacctcaggtgcggcctctacataactccctgtattatacaaatttgacagagacttgattgatccggcgctcccgatttgcagaatggaggagttgctgattgattccagccggagatagttgatttgaatggtttgattaatatagaagttcatgagcctcactccttttacgcattggccacgatcggctgatcaaccgcatcattgtcatacacattcgtcgcgttttgataattcatcaccttgaggctgtcgccggtattaaagctgccagcaccggcaaacgttctgacctgagcctgaggagaaatcgtaatgcagtccccgatgtgaacgactccgctcgtaccaatcgcattaattttaaacgctccgacaatggccggcatacgagcacatcctttgttgaaaaattgaaaaaagacaggtaaagtgaaatgacaattctgatttcaattgggctattcacgatagcttatgacaaacgcacatatgtgtgagagaaatttaaaggggatatatcggcttttgatgaaagcgttttattttttgggccgttatgtttaaacatggtaaaagaggatgttgggtataaattgagcggaaatgcggcgaaggatgccgctatccgcctatggtgatttttgtttatttctttggtgtttttgcgtgtagaatgctttttggagtatgtcgtgctgcggtattcgatttttgggcgggcacattctcgccctgaggtatatctcagaagtgctgagcaaaaatcggagttacatgtggtgtattctaattgttatagaaaatgatttacatacgggagttttcaagatatctcccaaaatcatttcttctttaatccgggtattcagcaggatatccagctcttggctgcattgaatcgtttcttttgaattcatgccgtatttttgtgcggtttcaattagtgtgatcctcatttcttcaattttactgttcattacgctatctccaattctagattttattttgatataaatacaggatatcgttagtataacctattttggctcaaaaggttgcctttcgtcaatttgactaaaaaagcgacaatttttgctgcggccttttttaatggagaaaggactaaagtcttgctaagtgtgcttgcaaaaagtcctgccgttcctcaatttctctaagtatgttggtctgctccttttcgatttgaaaggggctttttttgataaaaggatcatcagcagcactttgacaaatgtcaaggtgccattcgttgatgagaggagataatcgttcaatagtaaacgaccgcttcagcacgtttttcattaaggtgtgatattgcgacctgaaggcgggaatggatagaagccttgacgaaagcgtctttccttttgtcagaagcgggtcttcttcataccattcttgtacggcaagcgatcttgtctccatcggggaaacgtaaagccgaccggattcgtttaaacaaaatgtgtagtaaaagccttgattggtgcaggcgttgccgatcagccacaaaaaaaacagcttgacatccagatacaatttaatcctttcagccaattcgtcatctccggctgtgcggatcagtatgaaaaattcatgtaagaatgccgagaaatcattgttaaaaagggacaatggaacccttggatcggccgtcttcactccgtaactccttttaccggctggctgatggttcttgatgttcaaataaatgccttcaggctggccattgatggtcagaaagctgtacgaggcaacgggagcaggtacgccgatctggtcaaaaaaacaataggcgagtctgcgccgcatcagggacggatcatcctgttctgcattcaaaaaaagtgtcctttcaccaagcagagacttttcccagctgatttcataggatgccttttccgctctgtcacgctgtgtgagaagaatgggagaaacagatcgatctgttacgaaaagccccttggctgtacctttccttttcagctgctcccgatgaaaaaataaatgcacgcgctccatattctttcctccttctcaaaacgacatttgtatgatatgtagagcaagcccgtcctgaaacgaaatgaaaacggaattgagaaaaagggatttcagcattcgacagagaatacatgaaggagcattctgatttaaaagatgatggaggaataacatgaaatttgcgacaggggaactttacaaccgaatgtttgtcggcctgatcattgacgatgagaaaattatggatttgcagaaggctgaaaaaaaactgtttgaacttgagacgattccgggatcgctgattgaatgtatcgcagaaggggataaattcgttgcgcatgcaaggcagctggccgagtgggcaaagaaaccgaatgatgagctgggatcatttatgtattcattatctgaggtgaagctccatgcacccattccgaagccatcaaaaaatatcatctgcatcggcaaaaactaccgggatcacgcgattgaaatggggagcgaggctgatattccggagcatccgatggtatttacaaaatcgccggtaacggttacggggcatggtgatatcgtaaagagccatgaagaggttacctcccagcttgattatgagggagaacttgctgtcgtgatcggaaaaagcgggactcgcatttcaaaagaagatgcatatgaccatgttttcggatatacgattgtgaatgatatcacggcgcgtgatctgcaaaaaaggcataagcagttttttatcggaaaaagcttggatacgacatgtccgatggggcccgtgcttgtacataaatcatctattcaggagccagagcgtctcaaggttgaaacaagagtcaacggcgagctgcgccaatccggttcggcaagcgatatgatcttttccattccggaattaattgaaaccctctcaaaggggatgacgcttgaagcgggcgacattattgccaccggtacgccgtctggtgtcggcaaggggtttacgcctccaaaattcttgcggtcaggtgacaaaattgatattacaattgatccgatcggaacgctgtcaaaccaaattggctgaataaaactgaagggcggacccggacccgcccgttttttctgataatcatctttgtgacagaggacaagttcatggtactataagtggggtaatttatctgataggggaacatatatgacacacctacatattacgacatgggtggtagcgctgattctgcttttcgtcagctactcgctgtattcgtcaggaagtgcaaagggcgcaaaaatcactcatatgattctgcggttattctatatccttattattttgacaggagctgagctgtttgtccgtttcgccaactggaacggagaatacgccggcaaaatgattctgggcatttttaccatcggcctgatggaaatgctcctcatccgcaagaaaaaagaaaaatcaacaggaggcctgtgggtcggcttcgtcattgtccttttgctgacagtgctgctcggtctgcatttgccaattggttttcaattgttttaatagaaaaacctatgaacccggctctttgatagagttgggtttttttatatttatcccctcatattccaaatcatttaaaataaccttaaaattccctgtaagcggtatctcgtcctatgaaattatgataccttcaaggagattcattattttgcaggagggataacatgaaacgcagaaaattcagctcggttgtggcggcagtgcttatttttgcactgattttcagccttttttctccgggaaccaaagctgcagcggccggcgcgatcgatcaggcggctgctctggaaaacggcaaagagcagacaggcgccatgaaggagccggaacaggtgaaatggtacaaagtgaccccgggagcaacggatattcagaaaaactcacatatggcactgaccgtaaagagtgattcagtactgaatgtatctgtatatccaagtaaggaaaaagcgcttaaagatgagacgtttgagatgtaccgttctttcacagcggaggatggaaaaagcgaagtcatctttccatacgcgtggaacggccctaactatgtaaaagttgaatacctcggagaagaagagccagaggacgacggaacggcagaagcagctgcagaagctgcagaagccaagtatacgatcgggtataaaggcaccaaaaaacagccgtcagatttagaagaggaagaagcttgtccggttgaaatgagtgtcgatcagaagaaatcaggaaaaggcatactggataagctgagagcgattcgtgatgagcagctgagccaaacagcagaaggcaaagaactgacaagcctttattacaaagcagcaccgtttatcgttgcaaaactcgcactcaataaaacagcaagaaatgaaatctatcaggatcttgtgacattaaagccgttatttgacgatgtgtcagaaaacggagcatcatcttcgtataaggtaactgaaaaagatcaaaaagcgatcaaccggctatatgataaagctttgcaatcagtcccgtctttccttaaagaggagataaagaaacaagcggaccgactaaatatgaagcagctgcaaggcaaaacagccggagccattttaacagaaaacaatattgcagcaaaaagtgaagttcagacaacaaaggttattttcaaggtgaaggacaataaaagcctctcatccgtacataatgaaatgaagggcttttctgcaagcgcgcaatcgaaaaaagacatatccaatgtgaaaaaggcaaagaaactgtttgacaatctgtattcatttgaacttccgaaagacgagaaacagaacggcgcatatacggcaagcgccaaaagggtcaaaagcgctgctgcgacactatccaagatgtccaatgtagagtttgcggaacccgtgcaggaataccaaagcctggcaaacgatattcagtacccttatcaatggccgcttaaaaacaacggtgaaaacggcggtgtcaaaaatgcggatgtgaaatatgagcctgccaacacattgctgtccaaacgcaagcttaacgatacactcattgcagtagtagacacaggcgtagacagcacgcttgctgatttaaaaggaaaagtaagaacagatctcggacacaattttgtcggacggaataacaatgcaatggatgatcaggggcatgggacgcatgtcgcaggcattattgcggcccaaagcgataacggctattcaatgactggattgaatgccaaagcaaaaatcatccctgtaaaagtgcttgattccgcaggttccggagatactgaacaaattgctctcggcatcaaatatgctgctgacaaaggagcaaaggtgattaatttaagtttaggcggaggctacagccgcgtgcttgaatttgctttgaagtacgcagctgacaaaaatgtcttgattgccgcagccagcgggaatgatggagaaaatgccttatcttatcctgcatcttctaaatatgtgatgtcagtcggcgcaacgaaccgcatggatatgaccgctgatttctctaactatggaaaaggtctggacatctctgctccagggtctgatatcccgagcttagtgccgaacggaaatgtcacgtacatgagcggaacgtctatggcgacgccgtatgctgccgctgctgcaggattgctgtttgctcaaaatcctaagctgaaaagaacagaagttgaggatatgttgaaaaagacggcagatgatatttcctttgaaagtgtcgatggcggagaagaagagttgtatgacgattatggcgatccgattgaaattccgaagacacctggtgtagactggcattcaggctacgggcggctgaacgtcatgaaggctgtcagcgcagctgatttacagcttaaggtcaacaagctggaaagcactcaaacagctgtcagaggaaacgcgaaggaaggcacacttatcgaggtgatgaacggcaaaaagaaactcggcagcgccaaagccggaaaagacaatgcgttcaaggttaatatcgcgtctcaaaaacaggatcaagtactgtatgtgaaagcaacaaaaggcgatgcgaaaacatcgtataaagttgtcgtcgtcaaaggaaaaccttccggcacaccgaaagtaaacgcggtgaaaacgaaggatacggcagtaaaagggaaggcaaacagcaaagcgatgatcagagtgaaaaacaaatcaaagaaagtcattgcttctgccaaagctgacgcaaaaggaacgttttcggtgaaaatcaaaaaacaaaaagccggaacggtgctgtacgtcacggctgcggatacagataaaaaagaaagcaaggaagcaaaagttgttgttgaaaagtaaccaaaaagcggtgctcgatgcaccgcttttttatttgcgcccccgttggactgctgaatacataatggatcgctttccgtttgaagccgtccattcaaaacggtctcctgtcccttcgttgctgtagtgatgctgcatcgcgcattgtgcggtgtcatttgaaaagtgataaaaggacacaccctgccccgccgaagtattcgaaaagactcctttattataagaaaagacgcaatcgaataccgataagccgaagctgtgcaagtgctgcagaaatgcgagaaaggtttcgtcgtcaagcgaatccaaaagcgccataagcggccgcttgactgatttctcatagcggatgcgttctcccccggaaagggagatgttttcttcaccgcatgccagaaccaattgatcctggaagccggcttgctcccactttcctttatgatggacccagattgggctgtgttggagagtgtccgccaaaagtatatcaccttctccgttttcgattaaacagatgccgtcttcgatgaggatggtgccgtattcccattttcgttcctctgtatatatcaattgtttccgtttcatgcatgctgtctcctttttcttcattcctctcttttctttccaattcaagcctgtcccatacaactcttttatggacaaatcaactatctgcctatagatgcataaacttactaaggtgctgaaagaaacgaaattgttacgacagaaacgggattggagctgatatcacatgtgtggaattacgggttgggtcgattttaaaaagcagctcgtccaggaaaaacaaacgatggacagaatgacagacactctttccaaacgagggcctgatgattcaaacgtttggggggagcaccatgttttattcggacataaaagacttgcggttgttgatattgaaggcggacgccagccgatggcgtgtacctataaaggggatacgtacaccattatttacaatggcgagctttataacacggaagatttgcgcaaagaattgcgggcgcggggccatcaattcgaacgtacgtcagataccgaggtgcttctgcacagctacatcgaatggcaggaagactgtgtcgaccatctcaatggcatattcgctttcgctgtgtgggatgaaaagcgtaatctgctgtttgccgcgagagaccgtctcggcgtaaagccgtttttttacacgaaggaaggctcttcatttctcttcgggtcggaaatcaaagcaatcctcgcgcaccctgatataaaagcgcgagtggacagaacgggactttctgaaattttcgggcttggaccgtccagaaccccgggcactggcatatttaaaggcataaaagaaatccgcccggctcacgcgctgacattttccaaagacggacttaatatttggcgttattggaatgttgaaagcgaaaaacatacggacagttttgatgacacggttgccaatgtcagatcgttatttcaggacgcggtgacgcggcagcttgtgtcggatgtgcctgtttgtacgttcctatcaggcggtctggactcaagcgcaattacagcgattgcggcgggccattttgaaaaggaaggaaaagcaccgcttcatacttattcgattgattacgaagagaacgataaatattttcaagcaagcgcatttcagccgaatgatgacggaccatggattgaaaaaatgacagagactttcggcacgacgcaccacaaatgcgtcatcagccaaaaagatctcgttgatcatttggaggaagctgtactggtcaaagacttgccgggaatggcggatgtcgactcatccctgctgtggttttgccgggaaatcaaaaaggactttgtcgtcagcctatcgggagagtgcgcggatgagattttcggcgggtacccgtggttccatacggcagatgttgagtctggctttccatggatgagatcaacggaggagcggatcaagctgctttctgattcatggcagaaaaaattgaatctgaaagaatacgtaaatgccaaatatgaagaaaccttggcagaaacgccattattagatggtgaaacgggtgtggataaagcaagaagacagctgttctatttaaatatgctttggtttatgacgaaccttttggatcggaaggatcgcatgagcatgggggcgagcctggaagtgcgggtgccgttcgccgatcaccggcttgtggaatatgtttggaatattccgtgggaaatgaaaatgcatgataatcgggaaaaaggcattttacgcaaagcgcttgaaggtattttgcctgatgacattctgtatcgcaaaaaaagcccgtatccgaaaacacatcatccggaatatacaaaaggcgtcagcgaatggctgaaaacgatcagaagccaaaaggactccgtgctccataccttgctggacagaaaacaattagatcagcttttagaaacggaaggcttctccttcaaggtgccgtggttcggacagctcatgaaggggcctcagctgatcgcccatcttgctcaaattcatacatggtttgaagcgtatcgcattgatattgacgagaggtaggttcaatgcaaatgtgattaaaatccagagatgtatagatttaaataagaaggatagatgagcagggaaatatatgctctatctatccttttttgtacaacgcactatcgaattgcccccgcattccttcaataagaatgaataggttttaatgttctgccgataaaactagctgataccgggcttaactttaattccctagcccatacagaaagttgaccaatatggtgaatttcgtgagcgatgatatggtgtaatatttcatctcgcgtatataaaacacctgtctcccaaggaacgcttacaagttcatcttttatttgatctgaatgtgtttgtaaaacatcaattatttcagttcggaatgtatttgagagagatttcactttattgagtgtttgataatcagcgaactgaacagcgatatcttcttttccttggatagcacgaatccaactatattccacatcaataatatgaaaaagggtatataaaatattctctactccgccaagacggtttttaagtaattcttcagtggttagttgatgacaccaagtaaaccattgatctctaacctgccagttatattcaaaaaattttatcactgaactcactccaatactatcatgtatcataacaattagcccttttttccgtgattcctctattattgaagtgatgattgagaaatgtttacattctacctgttgtatggcattaaaaataataatgtatatctcgtcgatgatgctgtacgtcttgttacttttacaaagtaagaatcggcattttcttcatatacaattaggaaaaaacatactagacttgaagaagcagtgatacataggagtgagaaaaatgaaagagataaaagaagcttaccagcaatgcggacagattgttggcgaatacgcgccagcctgtttcaaagcattatcatatctcccgctaaagcaaagacaaacctcttgggcagtattgtcgttttgccacacggtggccagtgcagacgaaaaggtattgcccgcatttgaagctaaagctgatcatgtttaccaaaggacaaataacggtaatcaacatctatggaaggcttttgatcatgcgtatcggacctttacattggaaagcgaaccttttcgggagtttattgccgcacaaaaagaagacgccaagccgtatgatgaccttgatgaactgctcatgtacgcatatcggacgggcggttctgccggattgatgctgctgccgatactgacacgccgaaaacaagatctgctcaaacaagcagccgtctctctaggcttggccatacagctggttcgcttcttaagtaatcttggcacagatcagcaaaaaaaccgcattccccgtcaggtaatgcagcaattcggctatacagaggctgatctccaaaaaggcaccgtaaataaagcgttcacaatgacgtgggagtatatcgcttttgaagcagaagcctaccttgaagagtgtcaggatgccttgccgctatttccgcagtattctcaaaaaacggtgaaagccgctcttcatttgcaccgggctgttttagaaaaaatccgggcaaagcagcacgatgtatttcaacatcacttcgctcttacagagaccgaagtgaagcagattctgtctgatatctaaaaaacacccggccttgattgagccgggtgttacgccatacctttttgtatccagatacgtgagcgccatcttctgtacattaagattccccggacccattcatccgcgataaaagaaatccaaatgccggcaagaccgaaacctaggtggatgccgaaaagataagcaagcgggaggccaatgccccacattgaaatcattgccatgtaaaccgggaatttcgcatcccccgcagcccgcagagagttaatgataatgacattaaacgagcggcctggttcaagaataatggtcatggcaatcaataggcttgcagttgctataatgtcagggctttgtgtgaagagtccgatcaggtcttttgaaaagattgtcatcaaaacagaggtagccgcagcaattccgagtgcccaatataagctcttcatgcagcgctcataagcggcatcaaattgtttgccgccgatataacggccgattaagatttgtgtaccctggctgatcgcagtgccgaacagcaaaataaacatcgtaatattttgcgtatacacttttgttgtcaacgcctgcgcgcccatgatggcgataaaatacgtgactatcatttgcgacaggttgtatgaaagctgctctcccgcagaaggaatgccgattttcagcagcttgcgcaaatgctctttatgcatatgaaagacttttttcagcgacatcttcagctggatgcgtttgttgacaatcacaatcatcgcgattaatccgatgacgcgggcgatagatgtggacatggccacaccggcaacgccgaggacaggaaagccgaacaaaccgaaaatcacaacaaagtttccggcaatgtttaaaatgttcatgccgatagtgacaaacattgtatcttttgtgtagccgtagctttttaagatcgcgctgaatgtcatgattaaagcctgaataaaggacagacctccgacaacttgtaaaaagactttcgcatcaggcatcagtgcgtttgataatcccatcatatgaagcagagggacagccgcgaaaaagacgacggcgctgatggccaggctgatgaagaagttggcgccgattgacacataagcgacttccatggcttctttcttttgccgtgagcctagaaattgtgaaatgataacggtcgttcctgttgcgataaagctgaacatcacgataattaaatttaaaatctggttgctgacgccgactgctgctacgctgttatccgagtattggctgagcatcagtgtatcggcattacccataaacatatataatgagacctcaataaagatcggccaagtaagcgaaaataatgagaacgttttgtcagcgggttttttcaaagcagttgatttgaagacagcttgtttcatagtgtctaacccctttcgtaaataaaatcaacgttttaaagtgtacctccatttccttataataaaaagggatagaaacgatacttcttgtaaaaatccgacttaaaaaggaggatgattcaaatgcctcgcatcctgtttacagtcccgccttttccggtatttatcgcagctggggaaggggtttttaaaaaaggagaaacccatgtgagacgtgtattctccgtgtttgatctgatatatgtcaaacagggaacgttatatataacggaaaatgaaacatcgttttctgttgaaggcggcgagtacatcttgctttctcccggtcttgaacactacgggacgaagggcagtgatgaagcaacctcctactattggcttcacttcgatgaacatcgatatgaatttacggcaaagggaggcagcaactggtctgagcttcagcaggaaaaagggagcttcgaagagccggcccgctacggattggctttgccgagaaaaggcaaggtgcagcgcccgcagtttatggcccagcagtttgaaagactgattgattactccgcggaaaactccgatttgccgctcagaaagcaaattttatttgaggagctgatgctgcatcttcaaaaagaagcgttccaaataccgtctgcgaaagagcgggtagcctgggaggcggcccggtacttacaggagcactataaggaaaagacgacaatcaaggatctgtcgctcgcccttcactatcatcaggattatgtgagccgctgcatgcagcaggtgctcggcgtaactccggcacaatacacgaaccgggtgagaatgacggaagcgaagcgtcttttatcctctacaaatgataaaatgggcgttattgcggaaacggtcggaatggaagatccgacatatttttcaaaactctttaagcagatagaaggcatttcaccaattgaataccggaaaattgtcagccggaaagttcaataaccagacgagggatgaacatgaaaacaacaatttacgatgtggcaaaggcggcgggtgtctcgatcacaactgtgtcccgtgtgataaacaatacggggagaatcagcgataaaacacggcagaaggtcatgaatgtcatgaatgaaatggcatacacgcccaatgttcacgccgcggcgttaacgggaaaacgaacgaatatgattgctctcgtggcgcctgatatttcaaatccgttttacggcgaactggccaaaagcattgaggaaagagcggatgagctcggttttcaaatgttgatttgcagcaccgattacgatccgaaaaaagaaacaaagtatttttctgtgctgaaacagaaaaaggtggatggcattatttttgcaacaggaattgaaagccatgacagtatgtctgctttggaggaaatcgccagtgaacaaattccgattgccatgatttctcaggataagccgcttcttccgatggatattgttgtgatagatgacgttcgtggcggatatgaggctgccaagcatcttctgtcactcggccacacgaacatcgcctgcattatcggagacgggtcaacgacaggcgaaaaaaatagaatcaaaggcttccgtcaggcgatggaggaagcgggcgtgcccattgatgaatcacttatcatccagacgcggttttccttggaaagcggcaaggaagaagcgggaaaattgctcgacagaaacgctccgactgctatttttgccttcaacgacgtattggcttgtgccgccatacaagctgcgagaataagaggcataaaagtgccggatgatctttctatcattggttttgataatacgatactcgcagaaatggcggctccgcccctgacaaccgtagcccagccgataaaagagatggggcggagcgtcatcgaactgctggcagaagcaatagagggaaaacgaaaggcgaaacaaaaaatagtgctcccgcctgagcttgtagtcagacattctacatcaccgctcaacacatgagcccgctaatgagcgggttttttcattatgacagttgaagcaaaaaaaaacatattgcgtgtaaaccaatggcagtgtaaaatgaaaccatcttttgagaaagcgcttgcgcaaaatggcagagcggatagaaccgctgtttttttagctgttaagagaaagcgctttctcaaagcgagcctgaaatgagataaaggagaggatgggacgtggaacatcaagtaagatgtgcagtattgggattaggaaggctcggttattatcatgcgaaaaatctcgtcaccagtgtaccgggggcaaagctggtttgtgtcagtgatccgttaaaagggagagcggagcaggttgccagagaattcggtatcgaaaaatggtcagaggacccgtatgaggtgttagaagatcccggcattgatgctgtcattatcgtaacgccgacaagcacacatggtgatatgatcatcaaagcagccgagaacggcaaacagatcttcgttgaaaaaccgctgacattaagccttgaggaatctagagcagtgtctgaaaaagtgaaggagacaggtgtcatttgccaagtcggctttatgagacgattcgatcccgcatacgcagatgccaagcggcggattgacgctggtgaaatcggcaaacctatctattataaaggctttacgcgtgaccaaggcgcacctcccgcagaatttatcaaacacagcggtggaatttttattgactgttccatccatgactatgatattgcccgttatttgctaggggcggaaatcacttctgtttcaggccacggcaggattctgaacaatccgtttatggagcagtatggcgatgtggatcaggcgctgacgtatattgaatttgactccggcgcagcgggggacgtcgaggcaagccgaacctctccatacggacatgacatccgggcggaggtgatcgggacagagggcagtattttcatagggacattgagaaatcaacatgtgaccatcctatcggctaaagggagcagttttgatatcattccagactttcaaactcgttttcatgaagcctactgcttggagcttcagcatttcgccgagtgtgttcggaatggaaaaacaccgattgtgactgatattgatgcgacgatcaatttagaagtgggtatcgccgcaaccaattcctttcgaagcggcatgccggtacagctagatgtgaagcgcgcttatacaggtatgtaaaagctaatatggttgcatttgaggctttccgcaaaaaaaagcaaggacattttagcccttgctttctcttttctcatataaatagtacatataatcagtaggtacgcctgaatggcccagctgtctcagcatggcggttacgttccctctgtggtaagtgccgtgattgacgacatgcaggatggtgtctgcataggttgattccagtgtacctagtttcggatgctgcattgtgaaggtctgttctaagtccgtctggcggctgaagaaatcatgatactgtgactccagctcggcagcgtgctgtttaatcgctgccatattaccttgcgcggactctaatttgcctgcgctgtctataatctcttggtaggccactcccgaaagaacattcagccaaatgtagtcagccctgcacatatgaagcagcacgtcgctgacagaaggaaatacgctctttacttcttgataggcagtttcctccggcaggttttcgatatgggtaaatattttcttgtttgcccaagaatgatagtcataaaactgttttgcatcagtcataatcatgcccccttttctaagaaattcgtttttttcatctgtttctccttcaattgcaaaagagtgacaccccaaaatatcctgccgctgcccacattaccgctgcagagcatttgtttacgatcagcataagcctgccgctcgtatctatcgtctgaaacaaccggcccgctattgcaaggctgataaaccaaatccaagacacagcgatgcaggcggccataaagagccatttctcaagccccgaatattgaagagagctcgtgccgatgacgccgatcgtgtccagaatggcatgcgggtttaaaagagaaacagcggccgcaaatgcaacttgcttttttggtgtgaacgtatgtttctcgttttggcttgtgttcggacggctgttccaagtcacccagcccatatagagcaaaaataaaaatccgccggccatcatgactgtctcaaacacaggcagctcctgcacaatgacagacacgcccgcaacggctaatacgattaacagggtatcgcagactgaagcactgatgacagctgggagagcccgccaaatatgcttttgccacgcgccttgctgaaaaataaacacattctgcactcccagcggcaaaattaagccaaacgcgagcacaattccgtgaatgattgcattcatgctgaaaaagctcccttcacattttttttcaatcataagagagattgtcactaaagtctccagccatttggttgggttaggaaccagccaaatgtataatgtgtaaaaaagggggggcatgaccttgtcgcaatggcagccaagccgaaagtcggatgttccgctgcatcggcagatcgaacaatatatgaaagacaagattcttcacggagagtgggctgtagggacgaaaatcccctcacagagaacgctggccggcatgtttcaagtcaaccgcagcacagtcacagcagccatagatgaactcacgtctcaaggcttgatagagggaagaagaggcggcggtacgaaggttgtaaacagtacttggagcgtgctggcggctgagcctccgcttgattggagcgattacgtccgttcgggcattcatcgcgccaattcttccatcattcaagctattaatcagaacgaaccaagagcggatatcatcagattaggaactggagaactttcaccggatcttgtgcctgctgacacaattggacggatgtttcagcaaatcaatccgggcgtcctgtctttaggatatgagcagccgaaaggaaaccgtcagctgcgggaggcagtggccgaccatttaaaaggaaagaagatccatgtgtcaccgtctgcaattttaattgtgtccggtgcacttcaggcacttcagctcatctcaattggacttttaaaacgagattctgtcattttgacggagaagccgtcctaccttcaatccttgcatgtatttcaatcagctgggatgcggcttcgcggcttgccgatggatgatgaaggggtcaaagcggggcttgtttcttctaatcgaaaacaatatggaggacagctgctttacacgattccgtcgtttcataatccgacaggcacagtcatgtcagagcagcgaaggaaagagatcatcagcctgtcaaaaaaagagcagctgcccatcattgaggatgatgcgtacggtgatttatggtttgaagaaaaacctccgcagccgttgaaagcaatggatcatgagggcaatattctgtatctgggcacgttttcaaaaacggttagccccggtctgcgaatcggctggcttgccggtccggagccggttattgaaaggttggcggacattaaaatgcagacagactacggatcaagcggcctgtcccagtgggcggctgccgagtggctgtcacagggatattatgaagagcatctgacttgggtacgcaggaagcttaaagaaaggagagacgccgccgttcattttctcgagcggtatgccggggacattgccacgtggcggattcccgcaggcggcttttatatttgggtgacatttcacaaaaacctgcctgtcagccgtttcttttatgaattgctgaaacggcaggtgcttgtgaatcccggctacatttataacgctgaagaccgaaacagcatcaggctgtcatattcctatgcatctcttggagatttggaaactggcattaaagcggcagctgaaacagcacgccgcctgatgatgtcctaggctttggttatacgatgacagctcccagtgccctggcgaaggcaatcgcatgctcaggtgcgattttgcagcctttcaatttgtcgagggagacatgaagctgttcaaaacggcacgtgctgatgtccatgttttgaagggacgtgccggtaaagctggcgccttccaattcgcatccgtcaaagtgtgtctgctggagcaccgtattgctgcattcactttgcataagagcacagtgatcaaatcgaacttgtttcatatttgagtacgaaaatgaactgaaatgtccgtggcattcctcgaatgaaacattccgcagcgttgcttccgccacattcattccaaccatttttgactgcttaactgaagttctgtgaatgacagccccgctgaaatcggcgtttgataaatcgcacttttcaaagatcacatcggtcagttcaatatgccgaaaagacacatcgataaagacgacatttctgaataccgttttttcaacacagagtctttcgatatcttcgccgcagatggtacaatcttcaaacaaatgcatgctgattacatcatcctgcgtcacggcatcatgaaaatctgcggtttgcaggttttctggtatgtttggtttttgaattgcgattttattcatgtgatgacatcctttgctgcccgaaaaacagaggcttccgggttcaatttaatagatcgttaaggaaattgatacatatagtaaatcgtgaagagccttttcttggtacagcagcccgcttgttttgtaagcataaatggaaagattcctatacgtcaaggcgtttacaggccgaaaaagccaaagggaacaggaggaatgcggaatggggcattacatcaaaaccgaggagcatgtgacactgtttgtagaggatatcggacatggaaggccgatcatctttttgcacgggtggccgttgaatcataagatgtttgaatatcaaatgaatgagcttccgaaaaggggatttcgttttatcggcgttgatttgcggggatatgggcaatctgaccgcccttgggaaggctacgattatgacacgatggccgatgatgtgaaagcagtcatttatacgctgcagcttgagaatgcgattctcgccggtttttcaatgggcggcgccattgcactccgttatatggcacggcatgaaggagccgatattgataagctgattttactgtctgcagcggcccccgcgtttacaaaacgcccgggttatccgtacgggatgaggaagcaggatattgacgatatgattgaattgttcaaagctgatcggcccaaaacactggctgatttagggaaacagttttttgagaaaaaagtgtctccagagcttaggcagtggtttctcaatctgatgctggaggcttcctcctacgggacgatccactcgggaatcgcattaagagatgaagatctcagaaaggaacttgctgcaatcaaggtgccgacgctgatcctgcacgggagaaaggataaaattgcgccgtttgattttgcgaaagaattgaagcgcggcatcaaacagtcggaattggttccgtttgcaaacagcgggcacggagcattttatgaggaaaaagagaagatcaacagtttgattgcgcagttctccaactcataagaaaaaacccgacattgatcgggttttttatataattcctctgttttgaagtgcgttaatgatgagatcagctccatcggaaataaaggtctggtctgactcaatgatgaaatcgggtgaaagcggcgcttcatacggagaatcgatcccggtgaaatgtttgatctctccgtttcgcgcttttttataaagcccttttggatcgcgctgttcacaaacatgcagcgggcacttcacataaatttcgaagaactcacctttaggaaagagcgctctaaccatgtcccgatcctctctgaatggagaaataaaagccgttaaaatcatttgcccgctgtcgacaaacagcttcgccacttctccgatccggcggatgttttcaatcctgtcaccagtctgaaatccaaggtctttgtttaagccgtggcggatattatcaccgtcaagtacgtagctctgaatgcccttgcggtaaagcttttcatcgactgcattggccagcaccgattttccggagccggacaaacctgtaaaccagaggacgcagcttttgtgtccgtttaaggactgtctgtcagactttgagatggcagcgggatgccaaatgatgttcggattgtgtgtcattgcaattccccgctgttttgtttgatggcaacaggctgttggtgaagtcccttgatcagcacggctgcgacctcaggccggctgaattctttaggcggctttttgccttggcggagaagctctctcacttttgtgcctgataagtggatgtggtctcttgagctgtgcggacatgttttggaggtgcccatgtttccgcattttcggcaataaaagctgtgctcaaaaaacatcggcttgatgcccagctcttcctctgtgaatgattgaaaaatattttgggcgtcgtatgttccatagtagctgccgacacccgcgtgatcacggcctacaataaaatgggtgcagccgtaattttttcggacgagcgcatggaaaatcgcttcccgcggacctgcataacgcatggcggcagggaaaaccgataacatgacacgatcctttggataatagtgattaagcaaagcctggtagctctccattctgatatcgcttgggatatcgtctgactttgtttctccgacaagcgggtgaagcagcagaccgtcgaccgtttctaatgctgttttttgaatgtattcatgcgctctgtgaacagggttcctggtttgaaagccgacaatcgtcttccagccgagtttttgaaaggccgctcttgtttctgcgggcgttgcataaaactgttcgaaagatttgtcaggcaggcggctgaccgtgataggccctccgatatagtaatccgggcgcgccagcaatttttttacgcctgggtgggcaggatcgtttgttttaaaaacagacagtgcttcttgtgttttatcaggctggtatatatcggtgactgtgatcatgccgtaggtaacaccgtctttcacaagcttgacgtgatctccggcagacagctgttttgctgttttttctccgacaggcagcgtaatcggcaggctccacggcaagccgtttgccagcctcatttccttcacaacacgatgataatctttttctcccaaaaaacctgttaacgggctgtatccgccgatcgcgataagctccagatcactcagtgcaagctgatccagctctgcttggcacgcgcacccttcaaaatggcatgcgggatcacagcggttgattaatacccctccatggggttcgtttccattcaacgtgttcaacctccaattatacgtttccttgttttcttttctgcagttaatgaaagtttgacatcagcgtctcaacatcatttcgattctcacatcaagaacctgccatccgctattcctgatgcaggccgcattctgttttctcccgtccggcccatcttccagccctctcatcgttcgggtccggggaaggcaatgtacacatttcacagcctatgctcggataatgttgatcgtgcagtttgttataaggcaaattgtgcaggcggatgtacgtccaaacgtcatcccatgtccagtggatgagcgggcaaattttgatgagcttaaacttctggtccaggtttacgtattgaatatgctttctcgttggcgactgctcccggcgcagtcctgaaatccaagctgtcatgccggacaggtgctttttgagcggttcaattttccgcaattggcagcagaggttcgggttatgcttccatagctctccgccgtacttcgtcccctgttctgttaagctcagctcgggttcgagcatctggattgcaaatcccggatatcgctctttgacggtctcgatcagctcatatgtttcctgaaaatgaagcccggtatccaaaaagatgatgtgtgcgtttttgttgatttttgatattaagtctagaagcaccattccttctgcgccaaagctgcatgcgtacacaatcttttctccgtacgttcggtaagcccacttcaacacatcgagctcatcgatcaattgatccgttatctgtttggacagcatgtcgttccatgtgtcatatgtgatggtttcgttcaacgttttcccccgtttgcatctgctttttttatctattgatcgagttataggcagactattcattttttgcataaaggttcagggtttttacgtgccgcgcccgcctaaaatgaggtgcggaaccattaagagcccggctgaatatgctttttagcaaaatggttttatgcccaaggagaggtagtatgccgatagccatttatcaggggcatcatcattcgcttgccccggcggacattaacatcgtcattgatgtcatcagagcttttacggtcgcccattatgcgtttatcggcggggcgaaagagattttgttggtccggacagctgatgaagcctttgcgctgaaagacacctatccggattatgttttgacgggagaggaaaagggggtcggtatcagcggatttgatttagataattctccaaaacgtatggctgggcaggatatggcggataagcgcctaatccagaaaacaacaaacggcgtcacagcagcattgggggcgctgaacgcaaagcatctgttcgtaactggattttccaatgccaaaacaacggcagagcatgtgaaaaagctcgccgcaaacgattgtgtcgtgaacattgtggcttcccacccatcaggtgatgacgatatggcgtgtgcggagtatatcaaaggcatcattgaagggacaaatgcggtaacggctgaggaggcgattcaaagaataaaacgctcttctgttgcggagaagttttttgacagccgccagccattgtttgattcggaagacatcgtttactgtacaaaagaactgacgggcgattttgtgatgaaagtgaaacaagatggagaagttccaacgatagagagggtcataatatgaatgatttttcactagaattgccagtgagaacaaataagccgagagaaaccgggcagtccattttaattgataacggctatcccttgcaattttttaaagatgtcatagccggagcgtccgactatattgattttgtgaaattcggctggggcacatcattacttacgaaagatcttgaagaaaaaatcagcacactgaaagaacatgacattacatttttctttggcggcacactgttcgaaaagtacgtaagccagaaaaaagtgaatgaatttcatcggtattgcacctatttcggctgtgaatatattgagatttcaaacggtacgctcccgatgacaaataaagagaaagcggctttcattgccgatttttctgatgaatttcttgtgctcagtgaggtgggcagcaaggatgcggaattagcaagccggcaaagctctgaggaatggcttgaatatatcgttgaggatatggaagcgggcgcagaaaaagtgattacagaagccagagaaagcggaacgggagggatctgttccagcagcggcgatgtcagatttcaaattgttgacgacatcatttcctcggatattgatatcaacaggctgatttttgaagcgcctaacaaaacgcttcagcaagggtttattcaaaaaatcgggccgaatgtgaatctggccaatattccatttcatgatgccatcgcgttggaaacgctgcgtttagggctaagatccgataccttttttctgtaaaatagcggctgcggggctctcgtcgtgaagagagcctctgcctattattttttatggcggtacataggcgtgagatagggaagtgaggtcagacggatgttgtagatgaagtcgatgactcttgtcgatatcacttggcatatgagggcttgaatgacgatgccccagtcaataatagacgcggtgaccataaaaatgatgcaattcatgatgagcaggatcgttccgggattcccgccgcggtagatagaaatcatcagagcaagtgctccgaaccctccgtttgaaattttatatttgtataaaagtccgatgccgagtcccaataacactgcgccgcttgccagatcaagccacagattagatgtgatatccggaaaaaccgcatcaaagatcaataccgagacagaggtgacggtgatagaagcgagggtgccggtgaatgttctcatctccagccattttaaagcggtaaaaagcattgatacattcacagcccacactgaaaatccgtggggatttgaaacagataatgcaatagcaccgcaatacctgctgcaccgcctgttggaatatcatgcggaaataaaaacaaggacatgccgagtccctgtagtacgccgcctacgacaatcataaacgtaagttttgctttcatcagcagttcagccattaagtcatttgctcctttatgaaaagacttgtccgctgttttcattttatgaggctgtccattatttatgtctcaaaataaagaaatggcccagcttaatatgctgagccatcccacttgtagcgattgacgatctccatattgatctctgttccaatgccttttcctttcgggatgtggaccattccttttgaaggctgcaggctgacgagatctgtaaaaggattctccatgacgtcccactcgatcggttcaatgtgatcgttcttcattttagaccatgggggcagacaggcttgtgcaaataaagcatagagccgtgagagcgatccgtcatatgcatgggcggatgctctgacgccgaaataacgcgcgagctggaggcagtcccgaaactcatcaattccgttgacatgcatgacatcgggctgaatgatatccaaacagcgctgtgaaaggagaggcacatattgcgccgggcctttcatgttttctccaccggcaacaggaacagacaaacggcttcgaagcatagcgtaatcctgcgggtgatcaaagggcaaaggctcctcaagccagccaatgttcgtccattcggagaaatagcgctcccatttaaaagccgcagcggcatcgtagctttggtttgcgtccagaatcatcgtaatggagctgcctgctgtatgctgcagcgcattgatgtgccggacatcctccttgaatgaagtcccgccaattttgactttgatttgctcaaacccttttttcaactgggcttcaacattggagactgagcggctgatccattgcggggagtctgagtacgattgaaaagacgcgtacacaggaatctcctctctgtatcgcccgccccataattcgcaaaccgaacaatccgcagctttggctgcaatctctgtcagcgccatgcttacagcggaggccgcccgctggtgccatttttgaatcgtgcgcactaatgacaggcggctgccggcctgttttcctaatagaaacgggatgatccgcttcgtaaaaccgacatggagagcagggagccaatcaacgcattctccccagccgtctatcccgctttcggtgataatcctgatgagataacaagtccgatatcgtttaaacccattggcatctccgtatggcttttctaatcggtgaaatagcggaaaggtttcaatccgtacaattttcacactgggtgctacctttcctcagcgggctgcagccgattgccagccattttagggtcttctttctcttttgtttcttcattgttttgcttcacatggatgagcatcatcacaagaatcccgacaacgagagtcaatcccgcgatgcttaaaaacatgccgggtctggaccattgcatcaggcggccgaaaatcggaggaccgatcgctacccctaagaaacgtacagagccgtacagcgaggtgacaaatccccgtctttctttgccgacagccccggtaataaaactgttcacacaaggaaggacaagacctgagcctatactgctcagtacaagaacactgataaaaaggacaagattttcaatgaatgacagtgccgcgtaggatacggtcatgaacgccaatccaagtacgatcagctttttcattaacgattgcttttgcccgattttgcttcctgttgtataggacgtcacacacataaccaaaagcgggatcgctaaaatcaagcctttcttcacgccgtcggtgtcgtatgttttttcaagaacatctgagagataaaacaggatgccgaataaagtaaacaaacaggtcgcacctgctaaataagcggtaaacagccatctgccttcatgtttaaagacacttaacagcccttttgcatattttccgattggtggcggttctttttcctttttcttttctttaataaaaatccaagtcagtacgatcgaaatgatacaaaacacaggaaaggcaaaaaacgcgccataccagacaagcagggcgatcagcgagccaatgatcggcgatagcactttccccatgccgtttgaagcttcaacaaggccgagcaccttgctctcctgggcgcctttaaacagatctcccgtcagtgccatggcaattgggccggttccggctgccccgattccctgtaacgctcgtcctgccatgacccaagggtaggcattgtcaaaaaaacctgccgcaaacccggctaacaaaccgccggcaccatacaaaattaagcagggaataatgatgactttccttgagaatcggtctgcgagataaccgacaatcggaatcgcaaatgctgcaatcaaggaaaatactgtgatcacgagactgacttgaaattgtgataaatgaagttcagatttcatttttggcaaaatcggaataagcatcgagtttcctagggttaatattaaagggattgaaccgattgctacaaccgtcattccgttattttgttttgatgattccatctcagagcacactccttttcttctgcttagaatgtccctgatggcttcgtttattcagcgatcagacagcaaaaaaccgaacagaagatacctgttcgggaaaaaagagggttaaccgagagcctgtgaaatcaaagcatataagtgtccattttgaataggcgcttttttctgatagaacaaaagcggaggttcatcatctttacgaaatcccatttctatcaggctgtcatgcagagacgtgtgttcactcggtatatcgattcgcatcggcccttgtttgccggccgccagcctgttaattatttgtgctgcaacatctgatgatggagcgatgatggggccgaatttcaaattggccggtgtctgtacagaaagtccgtagccaattagctgtccgtcctgatttcgggcgatgatgcattcgcatgaagcagaaataagctgctgcaaaaggtttgatcgatctccgccaaaggcagccagatccgccgcggttaagtcgtgaaagtcttgttctctaaaggatgtcagttcagcatcaagcttttttgtataaggttgaaaactgtgacagctgtactttcgcactgaacctgccgtatgaaaacctgctttttcataaagcggcaaaccttcttttgtggcgcaaagcctgatggcggtgttttcacccgcttgggggatacaggcgtttaccatacgccggccgagaccgagccgttgatattctttgtccacgatcacgaggccgatagaagcaagccggccaaacaaaaacaagccgatgcaggaaataatatcaccgctgacattttgatagccgaaaaagcgtccttgctggacaatcagtgccagctcttgttcgccgtaatccggccacccggcttgcctgcaaagccgtaataagccggaaacatgttcttcatgaagctcaatcagcttatcgattaccctcatacagatcacctgcttgtttcgagttttttatacatgatgatatgagtgcctatgccgggaatctcaaacggttcgccgagtacttcccacccaagctttgaatagtagcctttcacatggcttctggcattgcaccagactgcctgaacgccgttctttgccagtttctcttccgcgtgtttgatcagcgtgctcccgcctttttgatcgcgatatccttcaagcgttgccatgcctctcagccgatatgctggggattctgttattaatggctgattttgcggggaaaaagaagcgatgctgatcagctttccttcaaaaaatgcgccgagatgaaaggagccttttgcatgatcctcttcatatttgcattgttcaatggattgatggggacgcagaatgcggtgccggatttcatatgtatcttccgcggaaatggttttgacttcgagcataatgttcctcctcatgactgtttttctatatcgtaacacgaatcccgttgaaaaagaccgcccgattggatcagacagtcttttaagggattaatgcaaaaagatattttggcgctgctcatctttttgctgaatataggaagtgagctcggcggttaagtcagatctgaggaaaggcgttatcaagtagatgccgttaaacagctcgcatgccgtatccagcagggagcgtgcaatcgcaaggccttccgccttttgcttttctttatcttcaccggcatgggccattttttcgcgaatcgtatcagacagcttaatgccgggaatttcattatggatgaattcggcattccggctgcttgtcagcggcatgatgccgatatagatcggcgtcttcagatgttttgtttcgttatggatatcgacaagctgctgctcggaatagacaggctgagaaacaaaataatctgcgccgcaatctatttttttctcaagccgttttaccgctttatccagatggcggacgttaggattaaatgcggcggcaactgagaaattcgttttcttgccgagcggttttccagacagagacagaccttcattgaattgtttgatcagcctgattaaatcaaaagatgttaaatcatatacagacgtcgcaccaggaaaatccccaattttagaagggtcacctgtaatcgcaagcacgtcattcaggcctaacgtatcaaggcccattaaatgtgactgtaagccgataatgttacggtcacggcacgtaatatggacaagggaacgcatatcgagctgttgcttgacaagggcaccgcaggcaacattgctgatccgcggggtcgccagagaattgtcggcgagtgtcagggcatcgattcccgcttcttttaattcagcagccgccgatagaaatttgtcaaagcttagttttttcggcgggtccagctctacgataatagagcgttttttcgctgcgatctcatccaggccgggctcggttcgctcgtgatgaacagaaatgaattctttcgcccgggttttgacttctttttctgtaatcggaaccagcccgccaaccgcttccgccatcgccctgatgtgattcggcgttgtcccgcagcagccgccgataatccgcgcgccttgcttacggaattctgacgcgctgttttgaaaatacgtgtcgtctgtttcatagacgagccgtccctcttcaagcgaagggagactgctgttcggataaacggataagaatacgtcatcaaaaatcggcacttcgctgagcgcttcaatcatgtgataagggccgaggcggcagttaatgccgacgatatcagctccgagatccgcaatcgagcgcaatgcgtcagaaagcggcgttccgtcctgcaatacgccttgctcgtgcatggagacattgagcataatcggaagatcagtctctttgcgcgcgattttcagcacttcacgggcttcttccaaatcataatatgtttctaacagcaagccatccggctcttcatgcagcagcagatacaactgctcgcggaagctgcgcttaatttcgtcaagactgtacgcgtttttattaaatgtccgtatgccgcccatcgttccaagcacgtatgcatcgcctgctgaagcccgcgcgatctttacggcctcctgattcatttttttgatgtcatcctcaagaccgtgtctggataatttaatatagttggccccgtacgtattcgtttgaataatgttggctcccgcttcaacatacgctttatgtatgcgctgaatttcctccggctttgaaatattgagctcctcaaaacacctgtcaatgccataggagtagaggagtgtccccatggcgccgtcaccgattaacacctgtctttgcaaatcttctaaaagtcccattgtctgcctcctttattcacgtcagcaaggaaaaaagagaaataaaaaaagtcctcttaagaagaagactttgtcagtgattttgtctcttcttatcttccaagctgttcgagcttgctggatttagcaccttggtcatggctgatcgccattacaccggttgctgaagcttcgtcgggccagtccctctgcttctcttgataagaacggatatgaaattttcgtgtcaggaagtgccaaaagatacctggcgtttttccctttctccaaatttaccgaaaataaagacaataatcaataggaatcagaaaatttatctgaaatttataaattgaacgtcaattggcagatctgctccccgtacagctgagataatctgctgcaggtcatctttgttttttccggtgacacgcacttgatcatcctgcacctgagactttactttcagtccggagtttttgatgatcgtattgatttttttgcgttgtccttgtcaatgccttgaacaagctttgcacgctggcgcaccgttccgcctgacgcgttttcaaccttgccgtactcaatgttttttgtcggtacgtttcgttttatcaatttgctgaccagcacatctttcagctggcttaatttgaattcgtcatcggaaacgaggataagctcctctttatctaaagaaatgtcgcttttgctgcctttaaagtcatatcgggtactgatttccttcagtgcaatttggattgcgttttgcacttcaggcaattccaccttggatacaatatcaaatgaactttcttttgccatatgaaaacctccataacatttaacttatgtgttgattatagtagaataaagagaaacttccaacagaacaaagaatcaatttgtgatgattggaaaaaatgttaacaaaatccgcagagaataagcggaacaggaaggacgatagcatgagaccagggcagcaattaaccttgagtatagatcaccaaaccgacttcggttattttttaaccgatggggaagatacgattctcttacataacagtgaaatgactgaggatatcgaggacagagacgaagtagaagtctttatatacgtcgaccagcaggaaaggcttgcggccacgatgaaaattccggtcatcagcgcggatgaatatggctgggttgaagtggtggataaagtggaggatatgggcgttttcgttgatgtcggtttatcgaaggacgcactagtcgcaactgagcatttgccgccgtacgaagatgtctggccgcaaaaaggggacaaactttactgtatgctgaaggtgacgaaccgggggcgcatgtttgcgaaaccagcgccggaagatatcatcagcgaactgtttaccgacgcttcagaagatctgatgaataaagagctgacaggtacggtgtacaggctgatcgcatcgggttcattcgtgatcacggatgacggtatccgctgttttattcacccgtcagaaagaaaagaggagccaagactgggttcaagagtcacaggccgggtgattcaagtgaaagaagacggttcagtcaacttgtcgctgcttccgagaaaacaggatgcaatgtcagttgatgctgagtgcattctaacgtatatgagaatgagaaacggtgccatgccgtacagtgacaaaagccagcctgacgatatcagagaacgttttaatatgagcaaagccgcctttaaacgcgcgctgggccatttgatgaaaaacggaaaagtgtatcaggaaaatggatggacatacgagaaaaaatagcatgaaaacggctcgcctgcagcagactgcggagcgagccgtttttttatgtctagtttaattcatcaaccagtgttctgattgccatttcgcgatccacattgtctgaaatcgcaatcggcgtaatatcaatggcgagaatgatcagaatcagggcacctgctgcagcaacataagaaacataatagaaatagttagcggtatcaacagtgttgacaagctcggcctgaactctggatgtatcatccttggaagcggcgatttcctttgcagcttctactttttcttcaacgatttgacctgcttttttcagcagttcatctactttcaatgcatctttgctgtaaacagctttcttcaggttatcaaaaaagtcagcatcctcttttttaatatcagcgacaacctgattggcaaaagcctttgcctgttttgtgttgagtttgtctgtcatcgctttattaaagacctctggaagctgtttgccaacttccccttgggcaaacacaaaccctttaaaaatttcctcacctgaatactcaagctgctttgcctgtgccacactttcttgctgcttcaccaaaaacacagtcgtcaccaatacaaccgacaaaaatactagaaacgccttcttcaaactgaaacctctcccttcttgtgttttttattccacaacagtctgcgaatatatgtaaattgaatcgtggaatcgataggagtgagatacaatatcaaaatgccggccatgataatggaaaaactgatgaggcccagcatgactgcaaaaatctcatgcataaaaacagcgatgatcaaaatcaatctccaatgcttcttcggcgcaaacagcgctgtgaagatgacaatttgaaccagcagcgtcccccatgtcggaatcaccacgaacggacttgttacaattggcttcgttaacgcctgaaaaaagccgttgaagccaatggttttttcctgggcaaaataatagacggccgttccgtccacccattcctgctgagacagcttagcgacggtagagtgaaaataaagcaccgccacttggattctgatcacaaaataagaaataaaagctgttatttttccaagtgttcttttgccctctataggtctcgtgctccaatgccattttctcggatcggtcagcgtgatgggaagcaataaaaaggtcatgacggctgctgcctgctcgcctccgtcgatgacgatcagcgatgactgcaggctgtaactgacataccaatgcagaaccccggtgattctggggcgccagccaatgacaacaagcaccagaatggcaatgaagacccatctgaaaagatttaacatcatatagttattttcgccgaggcaaaagagactgagattcattttacaagctggatagctgctgataccgctggctggcttcataatgaggctcgggtgattgatgagcagcgtcagcaggctggatagcgcaatgatgcttcgcgcgaggccgtatacatttgtccacgggtttctttcgtcccatctggtgatggtctgttttatgttttcgagcatgaaatcacaaccttgactatgctttttacctgataagacgaaggggtgtatttagaatagctccaaggaacaatatcctctttcgtcaaatagtagctgccacaaagcagcgggcggggagcgggtgtttttaattgcacggttttggctttgcttttgcatgcgccgaggtccttttttttacatgctgtccactgttccttgccgacttggctgtagatcacgcccatttcaacgccttgtgaccgcccataccgatacaggccgaataggttgtcagccctcatattgggccatctgaccttggcgctggcattttcagcctcatataagccgattgcagtatcacgcggatttttgctaaaaaagccccagccctgagggaggatgctggacatgagaaatttggagtcctttgtcagcggaatcggggttgtccctaagctgccaataatagaaaacagaaatagcgaaccccaaaggattgaaaaaatgacaaaaaatgatatcgatttctgcattcgactgctccttttaacctgaagaatcgtttttacacttttcataatataaaaacatttatgtaataaaaaggttaaaaagtatgagaaattccatttttgttaaaaggaaaaacaggacattttacactgctatatgtgattgatatatagtggttttttcgatatatttaaaccatgaaaacgaatcaagttaatgaccgctggattgttcaatttcgaaaagggattttcgagctggccatcctatcccttctgcgttctaaaccgatgtacggttatgagctgacgtcatccttaaaaaccacctcggcgctggctatttcagagggagcgatttatccgattttgaaacgtatgaccgagaagggatggatcgaatttttttgggaagattcactggacggcccgaaaagaaagtattacaaaatgacacaaaaaggagaagaaatgttaaaagaacggctggagaaatacctggaaacccatcaagccttactgtctttatcggggatttgctatgaatggacagcttatcattgaccgatacatggaggaactaaatgcagagctggcgaatatgcctgatgtagagagagaaaacgctatcgacgaattaaaggggcatatcaccgctttcgttcaagacagaatcaaagccggccttagtgaagaggaactgcagaaagctgttgaatctgaattttctcatccgaaggagcttgccgaattgatgatgggtgatgggggagagacgaaaaggaggaggtctttattgggcaaaagctggctttcggtccttctcattgtcacgattatcgccctgccgctgctgccgtccgacttcagacatctgccgctggctgtttatttaatggtgctcgccggatatgtatggaagcggaaaaaattgatgatgtttgcaggtgtcagaaaaaacaaaatgcgctctcaaaaggagattgttacgatttcgcgagtcggtgcggtttatctgctgtttttagcagtgctgcttcttttgagcccgttcctcaatgcgcttgtcgtcctgctgctgattgcagtaagctgcgccgctttttttctttttcttaacatcaagtaatcttgtaggaggctgtaagatggaaatcagcatcaattatctattaattgtcatcgcgcttttattctttgtggttgcctattttgtcggaatcaaaaaacaaacctggatgctggctgggtttaacgaggcgcgtatacgggataaagaccggctggccagaatagcaggctactttttcttgaattccggtttgttcattttgctgaatagttttatctcatttcaaggtcaggagcagctcatacctccgcttatactggcatatggagcaggggttattatttatgtcaataaaaaattagtagagtagaaaaagaagggcagagcgaaatatctccgcccttcttttttgggaaaataagaacgaagcaccacatacaagtttttgtatttttgataggatgaagaaaaatggtagattccaaaataggaaggatgtggtgttttgcgcaacctgaccaagacatctctattactggccggcttatgcacggcggcccaaatggtttttgtaacacatgccttagctgatcaaagcatcaaatacgaccatacgtatcaaaccccttcatacatcatcgaaaagtcatcgcagaagccggtacaaaacacaacccagaaagaatcgctattttcctatcttgacaagcatcaaacgcagtttaagctcaaagggaatgcgaacagccattttcgcatttcgaaaaccataaaggatccaaagacaaaacaaacgttttttaaattaacggaggtttacaaaggaataccgatttacggctttgaacaagcggtcgcgatgaaggaaaacaaacaagtgaaaagtttctttggaaaggtgcatccgcaaatcaaggacgtctccatcacaccgtctatttctgataaaaaagcaatacatacagcaaggcgtgagctcgaggcttccattggaaaaatcgaatatcttgatggggaaccaaaaggcgaattatatatctatccacacgacggtgaatatgatctcgcctaccttgtgagactctcgacatctgaacctgatcctggctattggcattatttcatcgatgccaaaaacggaaaggtcattgagtcctttaatgccattcatgaagcggcaggtacaggaatcggcgtgtcaggtgatgaaaaaagctttgacgtcacagaacaaaatgggcgcttttatttggctgacgaaacaaggggaaaagggatcaatacgtttgacgcgaagaacctgaacgaaaccttgtttacgcttttgtctcaactgatcgggtatacgggcaaagaaatagtcagcggcacgtccgtatttaatgaacctgcggctgtagacgcacacgcaaatgcgcaagccgtttacgattattacagcaagacatttggccgtgattcttttgatcgaaacggagcaagaattacgtctaccgtgcatgtcggcaaacaatggaacaatgctgcgtggaacggtgtccagatggtatacggggatggagacggttcgaaatttaagccgctgtctggatcgctcgacattgtcgcgcatgaaatcacacacgcagtcacacagtattccgccggtcttttatatcaaggagaacccggtgcattaaatgagtccatttctgacattatgggcgcgatggctgaccgtgatgattgggagatcggcgaagatgtctatactcctggtattgcaggagattcattgcggtcattggaggacccatctaagcagggaaatccagatcattactcgaaccgctacacaggaacagaggattatggcggagtccatatcaattcgtccattcacaataaagcagcttatcttcttgcagaaggaggcgtgcaccacggtgtacaggttgaagggattgggcgtgaagcaagtgaacaaatttactatcgggctttaacatattatgtaacggcatctacagatttcagcatgatgaagcaagcggcgattgaagctgccaatgatttatacggtgaaggctcgaagcaatcagcttcagtcgaaaaggcgtatgaggctgtcggaattctataagcaaacaaaaacagtcaggacacagagtctgactgtttttgtttgctcattttcttaaaaaaaatatcgccaatgtacctggaccggcatgcgagccgattgctgaactgattggatgcataatgatttctttcggcttgaacgcttcctcaatcaggtgtttcatgtccgtggctttttctttgttcgcggcgtagctgatcccgacggtttgatcgctccaatcatccccgcgctctttcataagctcgatgatccgtttgaaaagtttcttctgtccgcggattttttccagaggcacaagcttgccgtcctccatctgaagcagcggtttaatattcaacaggccgccgacaaaagcggacgttttggatatccggccgcccctcgcgagatatgttaaatcatcaacggtaaaaatgtgttcaagctggctgcaaaagttctttacagacgtttcaatttcttgtattgtattcccgttgatacagagatcggcagcatgccggacagccagaccgtatcctaatgaagcgcatttggaatcaatgacccgcaaatcgaaatcggggaattcctccttcacttcattggcgatcattacagctgtctgatacgtgccggagagacctgaggaaaaggcaatgtaaagagcgggatcacctgtttcggcatattgcaaaaacacatttttaatcgtttgcggtgaggcttgggacgtcttaggcgtttctccattttgcatcgcttcaaatatttgatccgcatgaattgtgactgcatcttcgaattctttatcgccgagagaaaccctgagcggaataaagccaatgcctttttcttcaaaataagaacgaggcaaatcagtggcgctgtcagcgatgagatgaactgtcatattgcttcccttctttccgttatcgctcgttatcatgagagttaagccaactatatcatattaatttgccaatatcgtgttcaaatatttgttttaagggaaaacataataaagaagaaagagcggaggaacatgccatggtactagatcaaacaaaaaaattactcatcgtcatcatcggcgctttactcaatgctgccgggctgaacttatttttgatacctgcagatgtatatgccagcggatttacaggtgttgcccagcttttatcaagcgtcgttgatcaatatgcccccttttacatatcgacgggaacgctcttgttcctcttaaacattccggtcggtattttaggatggctgaaggtcggcaaatcgtttacagtgtacagcattttaagtgtcgctctcactactctgtttatggggatcctgccggaaacaagcctgtcacatgacattttgctgaacgcggtgttcggcggcgtcatttccgcagtcggtatcggcttaacattaaaatacggagcttcgacaggcgggcttgatatcgtcgccatggtacttgcaaagtggaaggataaacccgtcggcacgtatttcttcattctgaacgggattatcatcttgacggcaggattattgcaaggttgggagaaagcattatataccctggttacactatatgtgacaacgagggtgatcgacgccattcacactcgccacatgaagcttacggcaatgattgtgacgaaaaaagcggacgaaatcaaggaagccatttacggaaaaatggtgcgcggcatcacaactgttccggcaaaaggagcttttacgaacgaacagaaagaaatgatgattatcgtcatcacaaggtatgaactgtacgatttagaaaagatcgtcaaagaagttgatccaaaagcatttacgaacatcgttcaaacgacagggatttttggtttctttagaaaagactgacgaaagcaggtggaagtcgtgaaacggctgcttgtgatgctcctccccgtgctgcttttgataggctgcgggaaagatgagcagacagaacccgataaggaggtatcaggcggaatggagaatcaagaggttgttttatctattgacgcaattcaggagcctgaacaaatcaagtttaacatgtcgctgaagaaccaaagcgaacgtgctattgagtttcaattcagcacagggcaaaaatttgaacttgtcgtgtatgattctgagcacaaagaaagataccgttattcgaaagacaaaatgtttacgcaggcttttcaaaacctgacgcttgaatctggagaaacatatgatttctctgatgtgtggaaggaagtcccggagcccggaacctatgaggtcaaggtgacatttaagggcagggcggaaaatctcaagcaggttcaggctgttcagcagtttgaagtcaaataagaggctatggcgagtcgccatagcctttttttattgcagtttgtccagctgattttgaaattgatgcaactgttgacgttccgcatctgtcgaattggcatacgcagaagatacagcatttttggctctcagaatcgcttgctcctgatcgccttcctcaaagccgtttgtcaccatgaccgcctgttgaacaaatgattttgcctgctgaaacagttcatttctcatttaatattcatactgcctttcagccgagtctcgtgccgcggcatgctggtgagcttcttctaaagtagaccgatatggaaatcttgcggcgtgtagcccgatggagtctttaccctgctgaataaaccttctggatttgcttcgtttacccattttgagactgcccccttccatactttgacgagatgagtcgtcttcaatagtatggtggggtaaagtaaggtttatgagtgggaaaaattaatacggaccttctttaaagtgagaaatattctttcaaaaaccttgccacgccgtcctcttcatttgtggccgttgttcggttggcaatctgcttgaccgcgtcaattccatttcccattgcaacgccgcagcctgcaaattcaagcatttccaaatcgttatcctcatccccgaaagcaatgatccgctccctaggcacgccgtaataatcgctgattttctgcaggccgaccgctttattcatgccgcttttgataatttcaatgacatgccacggtgcggcccatcttctatggtcgatcacttcggcatgcacatccgataaatatgagcgtattgacggcacatcctcttcctttgcatgtatgagtacggacgtcacatcttcaccaagattttcccgcaagtctccgaccgttacatttgttgtgttcatgttaaaggcatctatcaggtgctcatcatggtaatgaaagtatacgtcgtcaatcacttcagcaagcacgttatgtacgttgtagctctcgctgatatccacgagctgtttgacaacatcaagcggcagtgacgtatgataccgtccccagctgtcgtcttgcggatgatggacaaatgctccgttaaaattgactattggcgttgtcagctccatctgctggtagtacatggaacttgaacgatacggacggcctgttgagatgcagacatgatgcccgtcatcttttaggcgctgtatcgtctgaagggtgttttcagatatggttttatcatcctttaataatgttccatctaaatctaatgcgattaaatagggttttgtctccatgaaaagctcctttaaccttagattttgcttgttttgccttacttacagtgtagctttttaccatctttattgtctacatgttacacttatgattatggttatcctaaggaggggcacattgtgatacaaattgagaatcaaaccgtttccggtattccgtttttacatattgtaaaggaagagaacaggcaccgcgctgttcctctcgtgatctttatccatggttttacaagcgcgaaggaacacaaccttcatattgcttacctgcttgcggagaagggcttcagagccgttctgccggaggctctgcaccatggggaacgtggagaagaaatggctgtcgaagagctggcgggccatttttgggacatcgtcctaaacgagattgaagagatcggcgtgcttaaaaaccattttgaaaaagaaggcctggtagacggcggccgcatcggtctcgcaggcacgtcaatgggcggcatcacaacgcttggcgctttgactgcatatgattggataaaagccggcgtcagcctgatgggaagccccaattacgtagagctgtttcagcagcagattgaccatattcaatctcagggcattgatatcgatgtgccggaagagaaggtacagcaactgatgaaacgtctcgaattgcgggatctcagccttcagcctgagaaactgcaacagcgcccgcttttattttggcacggcgcaaaagataaagttgtgccttacgcgccgacccggaaattttatgacacgatcaaatcccattacagcgagcagccggaacgcctgcaatttatcggagatgaaaacgctgaccataaagtcccgcgggcagctgtgttaaaaacgattgaatggtttgaaacgtacttataaagcactaagttattaacaagagctgaatttacgttatactgtagaaaaaaggagtgagggaacgtggaagaagcattaaaagaaaacatcatgggcgccctggaacaggttgtcgatcctgagcttggcgttgatatcgtgaaccttggtttggtatacgatgttgacatggatgaagacggcttaacgcacgtgacgatgacactgacatcaatgggatgccctttagcgccgattatcgtggatgaggtgaaaaaagcattagcggaccttcctgaagtgaaagacacagaggttcacattgtatggaatccgccttggactagggataaaatgtccagatacgcaaaaattgcgcttggcattcaataaaacaaaaaaggacagcctgatatgtgaggctgtccttttttacagctgaaaggagtgaaaggaaatgatgtacctgctggcagttttatgcccgccgcttgctgttttgttttcgggaaaaccgtttcaggccttgctgaatctcatattgacctgtatcttttggctgccgggcgcgattcacgcctgctttatcgtcgccgaccgccgtgccgaaaaacgggctagaagataatttggaaaaatgaggatgcattcgtggtataatggtcataaaaaacagcagggagagcactatgaaaaagaaattgcttgcattcgcgctttgtactggcgcgtatgcggccctgtttgcgtactctgtgaacccagagcaaaaaacagacacaagcgagatgacggatgtcagccgcctgatgcctgtaaaaataaagcagacagtgaaagggcaggaagaggaaacgctcattgacacagtcaaagaggcaaatcgaaaaaacataaaaatttcaatcgccgggacccagcactccatgggcggccatacatattatgaggacggcatcgttctcgacatgacgggctacaacaaaatcctgtcactcgatcaagagaagaaaaccatcagggtgcaaagcggtgcaacgtggaatgatatccagaaatacgtgaatccatacggactcgcggtaaaagtcatgcagtcacaaaacatttttacaatcggcggatctctcagcgcaaatgcacacggacgtgatattcgctacggctcgctgattgatacagtcaaatcatttcggcttttaaaagctgacgggacgattatcactgtcactccaaaagatgatttgtttacggcggtcatcggagggtacggcctttttggcgtgattcttgatgtaacgcttgagctgacagatgatgagctgtatgtcatgaagacagaaaaaatgaattacagcacatactcagactatttttcaaagcatgtaaaaggaaatccagatgtccgaatgcatctggcgcgaatttcaacagcgaaaaaaggatttctgaaagacatgtatgtcacaaattacgtattggctgatcatcaggatcaactgccatcatacagcgatctcaaagaagatgagtatacgggagccacaaagtttgcactcggtttgtcaagacggtatgaatggggcaggaattggctgtgggacacacagcaatcctatttcctgagccaaaacggcacagagatttcacgcaataacgtcatgcggtccgaatcaaagtttcttgagtatgaaaacaatgacaacacagatgttttgcaagaatactttgtgcccgtgaaggagtatgggtcctatattgatgacctgagacaaacgctgtcggacgaagatctgaacctgctgaacattacgatccgctacgtgcagaaaaatgaaaaggccgacctttcctatgcgaaggacgatatgttttcgctcgtactattaataaacgagggcttttcaaaagaagaccaggcagatactgcccgaatcatcaggcacatgacagacgttgccatcaagcacggcggcagctattatctgccttatatgacctaccagacaaaagcgcaaatgagacaggcatatccgaaaagtgaagcgttttttcagaaaaaacgaacctatgacccggatgagcgctttatgaattacttttatcagaggtataaataatggggaaaaacaaattaaaatggctgacattatcacaaagcagcgtgtttttcgcaagcagcttaatctttccgttttatattctgtttgtgaaaaatatcggctcaagctacacacagttcggtttttcctacggattgttcgggttgagcggagcgctcatttacccgctcctcggacggctgtctgaaaggtttgacagccgttattttctgcttctgaactcgtgggggatggctgttctgcttttatatgtcccgcatatcggaagcgtcgttcaagtgtacatcgtccaagtgctgttagggctctttggagcgatgcaaaagcatggagaaaaagtgctgatcgctaattttacagacagcggagagcgtggaaagaagattggaaattaccatttttggacagctgtcttttcagcagcagccattatgctcggggctttctcgctgacttttttacagtgcaaatgattttttatgcaagctctattctatattttttgagtggattgatgatgatgaaaacaggctgacgcggtcagcctgtttttttatgcggctgaaatgttgcgccgcatcaacgtttttgtgctggagtcgtgctggtttttttgagcggaatttccattgaacagaaaatttataaatgaataaaaatattaaatatacgattgaattaatttttattcatgttataatgttaaataatttcacaaagaccaagagggtgaacttgttttgaaaataggaattgtaggtgctacaggatatggaggcaccgaacttgtcaggattctttcgcatcatcctcatgcagaggaatgcatactttattcatccagcggagaagggaatgtctatagcgagggttatcctcatcttaccggcttagcggatcagaagctgaagccgattgatatgaatacgatcaaacacgaaatagatatcatgtttctcgctgcgccgcccggagtatcaagtgaattgactccaaagctggcagacgcgggaattccggttattgatctgtcaggtgatctgaggatacaagaaccggctgaatatgaaaaatggtataaacggacagcggcaccgaaggcagtgattcaagaggcggtatacggtctggcagaactgaatcaacagcaaattcaacaggcgaaactcattgccaatccaggctgttttccaacagctgttttgcttggcctcgcgccattggctcaaaagaaactgctcgatgaatctttcgttatcgttgacgcgaagacgggtgtttccggagcgggaagaaaagcatccatgggaacccatttttctgagctgaacgacaattttaaaatttacaaagtcaatgaacatcagcacacgccggaaattgagcaggcgctgaatgaatggcagccaggcctcgggcccattacattttcggctcacttggttccgatgacaaggggcatcatggcgacgatgtataccagattaacctgtgatctatcagcagatgacctgcatgatttatattcggaattttaccaagattcatattttgtgagagtgaggccaaaaggtcagtacccgcaaacgaaagaagtgtacggcagcaatttctgtgatatcgccgtgaccctcgatgagagaacgaacagagtcacgatcgtctcggtaatcgataatttaatgaagggtgccgccggtcaggcagtgcaaaactttaatttgatgaatggctggaatgaagaaactggactcaccatcacgccaatttatccatagaacgggagagaatcgaaccatgattcagttaagtgaagatcaaattgtaaaagtaacaggtgatgtatcctcgccaaaagggtttcaggcaaagggtgtgcattgcggactgcgctactcgaaaaaagacctcggcgtcattatcagcgagacaccggccgtgagtgcagcggtttatacccaaagccactttcaggctgctccgatcaaagtgacacaagatagcttaaagcacggaccgacactgaaagccgtcatcgtcaacagtgccattgccaatgcctgcacgggagaacaaggcctaaaggacgcatacacaatgcgggagagctttgcttcacagcttggcattgagccggagcttgtcgctgtttcatccacgggtgtcatcggcgagcatttagacatggaaaaaatccacgcggggatcgagctgctgaaagaaacacctgcgggatcaggcgattttgaggaagcgatcttaacaacagatacggtgattaagcagacgtgctatgagctggcaatcggcggcaaaacagtcacgatcggcggagcggccaaaggctcagggatgatacatccgaacatggccacgatgctgggatttgtgacaactgacgcggcaattgaagaaaaagcgctgcaaaaggcgcttcgggaaatcactgacgtttcatttaaccaaatcacagttgacggagaaacatccacgaacgatatggtattagttatggcgaatggctgcgccgaaaacgagtgcctgacagaagaccatccagactggccggtctttaaaaaagcactcttgctcacttgtgaggatctggctaaagagattgccagagacggagaaggcgcgacaaaactaattgaagcacaagtacagggagcgaaaaacaatcttgatgcaaacgtcattgccaaaaagattgtcggctcaagtctcgtgaaaacggcagtatacggaacagatgccaactggggcggatcatcggagccatcggacactccgcagctcaagtgacggcagaagaagtagaggtttatcttggcggccaatgcctgtttaagaataacgagcctcagccattctctgaatctctcgccaaagaatatcttgaaggagatgaaatcaccattgtcatcaagatggatgaaggggatggaaacgggagagcgtggggctgtgacctgacctatgactatatcaaaattaacgcgagctatcgcacgtaataaaggggagcgaaatgaagaaaacaatcgtttttaaatgcggggaagcgtcatccgtgagctgtcggaggaattttttcaaaatctgaaagagctgatggcgtcaggctggaagctggcgatcgtacatggcgggggaccggaaatcacgaatatgctgaaacggttaaatatcaagacagagttttcgggcggacagaggaaaacaacgaagccggtgctggaagtggcggaaatggttttatccggttctgtcaataaatttttcgttgctgagcttgccaaacacggactgcgagccgcaggcatttctggtaaggatggaggtcttttggaggctgattatctagatccggaaacatacggagaagtgggagaaatcaaaaaagtcgatgcgtccatggtgaacgcgctgatggaaaatggcatcatccccgttattgcgccgctgtctatgacaagcgactgcaaaacgctgaatgtaaatgctgatctggctgcttcagcagtcgccggagcgcttgaagccgataagctgatgttcgtaacggatgtcgatggaatcatgaaggaaaagcagcgtctggacgtcctgacccctaaggagattcagatgctgatcaagcaggaagtgatcacaggagggatgatcccgaaggtcaattcagccttgtcagctttatcagatcaggtgtctgaagtcatgatcgtaaacggaaaaggatcattcttcgcagaacaaacctttcaagggacaaaaatcgtcaaagcaaaggaggctgtttcatgagcagcttgtttcaaacctacggccgttgggatattgacatcaaaaaagcaaagggaacgtacgttgaggatcaaaacggcaaaacgtaccttgatttcattcaggggattgcggtatcaaatctaggacactgccatgaagcggtgacagaggcagtcaaaaaacagcttgacagcgtatggcacgtatccaacctgtttcaaaacagtctccaagagcaagcggcgcagaagctggcaacgcatagtgcgggagatcttgtctttttctgcaacagcggcgcggaggcgaatgaaggtgcgataaagcttgccagaaaagcaactggaaaaacaaaaatcatcacttttcttcagtcgttccatggccgcacgtatgcagggatggctgcgaccggacaggataaaatcaaaacaggcttcggcccgatgcttgaaggctttcactacctgccatacaatgatccttctgcttttaaagctcttggggaggaaggcgatattgccgcggtgatgcttgaaacagtgcagggagaaggaggagtcaatccggcgagtgctgaatttttatcagccgtacagtcgttttgcaaggaaaagcaagtccttcttatcattgatgaaatccagaccggcatcggacggacgggaaaaggcttcgcatatgagcacttcggactctcaccggatatcatcacagtcgccaaaggattgggaaacggctttccggtcggcgctgtcatcggaaaaaaacagcttggagaagcgtttacccctggttctcacggaacgactttcggaggaaacatgctggcgatggctgctgtgaatgccacattgcaaattgtattccagcctgactttctgcaagagactgctgacaaaggggcgtttttaaaagaacagcttgaggcagagctaaagagcccttttgttaaacaaatccgcggtaaaggattaatgcttggaattgagtgtgatggcccggttgctgacattattgctgaattgcagacattaggcttgcttgtattgccggccggcccgaacgtgattcggctgctgccgccgctcaccgtgactaaggatgaaatagcagaagctgtcagcaagctgaaacaggcaatcgctcatcattccgctgtaaaccagtgattttttttcgatacaaaggcataaaaattcatttttataattaattattcatcaagaggtgggctgttagatggaaggttatttagtgttagaagatgggacatcgttcagcggcgagctggacggtcatgaaaactgcacgggagaagctgtttttttcacaggaatgacaggctaccaggaagtgctgacagatccatcatataagggacagattattgtatttacctacccgctgattggcaactacggcataaatgaaaaggattttgaaagcaagaaaccgcaagtaaaagccgcggttgtctatgaggcgtgtgatcacttttctcattatgaagcggtatacagcctcaaggagtatctacagaaatggaacattccgctgttaacccatgttgatacgagggctgtcgtgaagaaaatccgggcaaacgggacgatgggtgcgacagtcacagcctctaaagaaggagctgagattgcccttcaaccagagaatgtggcagagcaggcttccgcccaggaaatcagcacatttggcgacgggaataaacatatcgctctcattgattttggctataaaaagtcaatcgcatcatcacttgtcaaacgaggctgcaaggttaccgtggtgccataccagcaaatggaggccgtatacaacatcaaacccgatggcattgtgctatcgaacggacctggagatccgaaagcaatccatccatatttaggaaagatcaaaagcatcatcagccgctttccgactctaggcatttgtctcggacatcagctgatcgcgctcgcgtttggagggaatacttttaagctgccattcgggcataggggagctaatcatccggtcatcgaccgtaagacgaaacgggtctttatgacaagccaaaaccacagctatgtggttgatgaacagtcgattaatgaagaagagctcaccatcaggtttcatcatgtcaatgatacgtcagttgaagggcttgcccataaaaaactgcctgtcatgagtgttcaattccacccggaagcccatcccggacctgcggaaagcgaatggatttttgatgattatctaaagaatgtgataccagcaaggagagaaatcgcgcatgcctaaagacaccagtatttcaagcatattagtaatcggctcaggcccgatcatcatcgggcaggcggcagaatttgattattcaggcactcaagggtgcatcgcgctgaaggaggagggctaccgggtcattctcgtcaacagcaatccggcgacaattatgactgatgaagccttcgctgatgaaatttattttgagcctctgacagcagaaagcctgacagccatcattaagaaagaacggcctgatgggcttcttgccaatttaggcggtcagaccgcgttgaatttagcggtggagcttgacgaaacgggtgttttaaaagagcacggcgtcaaactcctcggcacatccgttgaaacgatacaaaaaggagaggaccgggaaaaattccgttcgttaatgaatgaattaaaacagcccgtgccggagagtgaaattgttgataacgaggctgatgccctccattttgcggaatccatcggttttcctgttattatcagaccggcttacacattaggcggaaagggcggaggaatcgcccctgataaagaagcctttacagctatgattaaacaggcgctattagcaagtccgatcaatcaatgccttgtcgaaaaaagcattgccggttttaaagaaattgaatatgaagtcatgcgtgacagcaataacacatgcataaccgtctgcaatatggaaaatatcgatccggtcggcgtgcatacaggtgactctatcgttgtggcgccgtcacaaacattgacagacgaagactatcaaatgctgcggacagcaagtctgacgatcatctcagcacttgatgttgtaggcggctgtaacattcaattcgcgcttgatccattcagcaagcaatattacgtcattgaagtgaatccgcgtgtaagccggtcatcggctctcgcatctaaagcgaccggttatccgattgcgaagatggccgcgaaactggcagtcggatacacccttgacgagctgaaaaatccgctcacaggctcgacttacgcaagctttgaaccggcactggactatgtgatcgtcaaatttccgcgctggccgtttgataaattcaaaaacgcagaccgcaagcttggcacaaaaatgaaagccaccggtgaagtgatggcgattgagcggaatttagaagcggcgatacagaaggcagccgcgtcccttgagttaaaaaatatcggaacacaccttccagagctcagcgggttgtcaattgatacgctatgggatttggcaatcactccggatgaccgcagatttttcgttgtcatggagctgttgagccgcagcgtctcgattgatgacatccatgaaaaaacaaaaattgatccgtttttccttcatacctttgacaacatcatcaaattggaaaaccgcctgatggaagcagggagtgatctctcttttgaattattgaagaaagcaaaggaaaagggattctcagacgcaacgattgcctcactgatcggcaaaacagaggtagaggtgcgcgcgcttcgcaaggagatgggcattacaccttccttcaaaattgtcgatacatgcgcggctgagtttgatgcgaaaacaaactatttttactccacatatttcggagaaaccgatggagacatcagccgcaaagagaaaaaacgcgcgctcattatcggatcaggcccgattcggatcggccaaggcgttgaatttgattacagtgcggttcacggcgtgctgacactgcaagagcttgggttcgaaaccatcatgattaacaataacccggaaacggtcagcaccgattatgaaattgcggatcgcctgtattttgaaccgatgacaacggagcatattgtaaacgtggcggagcaggagaatattgattttgcaatcgtgcaattcggcggccaaactgcaatcaatgctgctgaagcactcgaaaaagccggcattacccttctcggcacttcgtttgaaacgctcgatgtgttagaggatcgggatcaattctatcagcttcttgatgagttgggattgaagcacgcaaaaggagaaattgcttatacaaaagaagaagccgcttcaaaagcgagtgagatcggctatccggtgttaatccgcccatcttacgttatcggcggaatgggcatgatcattgttgactcgcaagcccagctttctcagctgctgaatgatgaggacagcatgccatacccgattttaattgatcagtatgtgtctggaaaggaagtcgaaattgatttgatttccgacggcgaggatgtctttatcccgacatataccgagcatattgaacgggcgggtgtccattcggggacagctttgccattcttccgggaccgtccatcacgagcgggctgcagcagggcatgaaagatgcggcacaaaaaattgcccgaaaactttcatttaaaggcatcatgaacattcaatttgtgatcgacaatggaaacatactagttcttgaagtgaatccgagagcgagccgcacggttcctgtcgtcagcaaagtaatgggcgttccgatgattccgctcgccacacgactgctggcgggagcgtccttaaaagatctaaatccggcagttcaaaatcatcatggagttgccgtgaagttccctgttttttcttctcatgcgatccaagatgtggatgtcaagcttgggccggaaatgaaatcaacgggagaaggcatgtgtgtcgcgtatgatgctaacagtgccttgaaaaaaatctatacaagagtctggagtcaaaaaggcagcatttatttgcaaaacgttccggaagatgtgaaggagttagcagaaaacgcaggttttacaatacatgaaggaacatttgcctcatggatggaacaggaagggaaatcgctccacattaatctgagcggttctgaagaagcacgcaaagaacgtttggaagccatgacgcacggcatccccgtctttacagaagaagaaactgtgcgggcgtttttacaaagcggttcaggccatccgcagcctgtatctctcaaagacctctataaaaaggaagtggcatcatgcacacagtgacgcaaaccagtttatacggaaaagatttattaacgttaaaggaccttagtgaagaggatataaacgccttgctcgcagaggccggtgagctgaaacaaaacaaaattcagcctatattccatggcaaaaccttggcgatgatttttgaaaaatcatcaacgcggacacgtgtttcatttgaagcgggcatggcgcagctcggcgggaacgccctctttctaagccagaaagatctgcagctggggcgcggtgagactgtcgctgatacggcaaaagtgctgtcaggctatgtggatgccatcatgatccggacctttgaacatgaaaaggtggaggaacttgccaaagaagctgacattccggtgatcaatggacttaccgataaataccacccatgccaggcgctggcggatctcttgacgattaaggagataaaagggaagcttaaaggcataaaagtcgcatacatcggtgacggaaataacgtggcgcactccttgatgatcggctgcgcgaaaatgggctgtgatatctcgatcgcttcgccaaagggatatgaagtgttagatgaagcagctgaagcggcaaaaacatatgcacttcaatccggctcttctatcacgctgacagatgatccgattgaagctgtaaaagacgcggacgtgatttattctgatgtgtttacaagcatggggcaggaagcggaagagcaagaacgtcttgctgtctttgcgccttatcaggtgaatgcagcgcttgtcagccatgccaagcctgactatacatttttacattgtctccctgcgcatcgtgaggaagaagtgactgcggagattattgacgggccgaactctgcagtgttccagcaggcggaaaaccgtcttcatgtgcaaaaagcactgctgaaggccattttatataaaggggaatcatcaaaaaactgctgagccaaactcagcagtttttttgatggcaacatattcacagccgcttaggcgcatactacagcaaaaaggaaaaggaggaaaaacagtgggacagcagcaccaattccggcccggacagaaagcgcctaataacggtgtctacgtagaaattggcgagacagggagcatggttaaaaaccctcaaaaggtccatctgtcagcaggggaaatgtttcccgaaacatcaaaccacaaccggctgtggacctacaaaagaaagccgtgaccactaaaaaacccaaaacaataaatgttttgggtttttggctttttaatgctggcttgcatttttgttcataggcatgatttctgctaaaaccatgattaagacatacagtacaacagcaatgacagatgatgttttgaaattatacgtaacgctgttcatgcttgcaaccaagtagcatgccatatgtgataaaaggaacgtccaaataaaggcaataatatatcgcacgtttccacctcgtccttctcattctattctaaaagttatcataccatacaaaaagcgaagggggaatccaattttagcagaaagtgaggtgacaaaagagtctgattcgtcacactttaatggtaaaatataaaaacgtcaatcattataatagccaaaaatgtaaaaggctaggactttaccttattcgtttcttttctatttacataagatagcgtgagatgaagtgtgaaaggaggcgggcaagcgatgggaataacggaaagatactttcaactgggaacggagcataatgtcattcatctgccctatcgcccgaacggcttcggtatctttatcttgggagacagaacccactttgtcggacatgattcaagcttttggcagcagcattatggcagaaatcagcttctgagcatgttgatcaatgaaggatacactctttttaacagcaatctgttcggaaggcattgggggcggaaaaagcagtcacctatgccaaacagctgatacattctgtgctgaagcaggaaatcctcaatccgaagattcatattttagcagaaggcatgggtgctctcgtggccgatgaactgcttcgtttttccccggatcatatccgctcagccgcaatgttgaatccttgtctcgatcttcaggcacattatgaatcggaaaaagaaaataaatttttctataagcaatttttgaaagaagtatcgaaaagctacggaatttctgaaaaagaagcggaagcgcttcgttataaaacaattcaaagctacccgagcggcgtaccggttcatatatggcagcgtatgaccggagctccatatccctacagtgtacatgcggaagttttcaaggaaaaacagcaaaagcaaggctcaccggtcgacatgacatttcatttatttgagcatccaagcagaatttatgcatcaatttgcaaattctttcacagtcatgaaaaagaattatagagaatataatgacagcagccttctcttttgcggaggctgttttgttttgggaaatgaaaaaccggaagggcggcagatgcaatggaatcaacgctgattgtaggtgcggacgaatttttcggcctttcattatgtgagcgaatgatggatgaaggcatacatgttgacgttgttctggcggaaacagaagataaaatgagacaaatgtacttagaagaaagactcatgtggcttgggagaaatgaactctttcgccagcttgaacacattggagaccaaaattatgatacaatttgtatccagttcggaagttttttgcctttagaccaatgtgattctccttatattttagtatatgaagaagaccgaaaagaatgggaaaaacgtgaaaaaacaggctcggaaaaaaccgtgatcctgccgaaaatgtatgggccatggaaagaagaaacagaggaaaaaggctattacacaaacgacgtggctgacgagttgctgagattcctgttagaaccaagccgtcatagcaaagatcagctttttgaattgcaagtcacagaaaaaacctcaaaagaagaagcaaaaacaaaaattatcgagtggaaaagacaattttcatcaattttcgacaaatattaagaaaaaccttccatgtttcgagttttctagatacaataaacgtataaaaataatacatgttatagcttgtcaaaaggagttgaacatgacttgatcacaaggcttgtcatgatcttttctgtcctccttttattgagtggatgtggacaaactccgttcaaaggaaaaattgagaaggtcggcatgctctttcctgatacgattaatgacctcgtatggggcacaaaagggtataaaggattactgaatatacaatccaaatacaatgtggacgtctattataaagaaggcgttaaaacagaagaagatatcataaatgcgattgaggattttcataagaggggtgtcaatctgctctacggccatgggagtgaatatgctgaggtgtttaacttggtcggcgaagattatccagatatggaattcgtcatttccaatgcgaaagcgaaagctgataatgtaacgagtgtccattttagcggggaagcaatgggcttttttggaggaatgactgctgcccatatgtcgaaaacgaatcaggtcggtgtaattgcttcctttacgtggcagcctgaggttgacggttttatcaaaggggccaagtatgaaaatccggatatagaggtaaatacgaaatatacggatcattgggatgatgatacaacagcagtaaagctttatcagaaaatgaagaacgaaggcgcggatgttgtgtatcccgccggagacgggtataatgttcctgttattcagcaaatcaaaaaagacggtctttatgccattggctacgtcacagatcaatcggatctgggcgagaataccgtattaaccagcacggtgcaaaatgtggacaaggcctatgaaatcattgctgaacaatttaataaaggcacccttgagggcggcgatcattactacgacctgaatacgggagtcgttgagatgggaacattcagcccgctcgtcgacaaagactttcagcaaagaatcgccaagctgatcaaaacatacaacaaaacaggcgagctgccaaaaaacgagtaatggagtgacgtcacatgcagcacgaaaaatcacttgaattcttgcaaattgccatgaaatatctccctgaagcgaaagaacagcttgagaaatcaggcattgagctctcaatggaggccatccagccgtttatgaatctatttacaacggtaatggcggaagcttatgagcttggcaagtctgacgctaaatctgaaacagaataagaagaagccacttttttgaaagtggcttttcacatgattttctttttaatagcggagagcatgggcgcaagctcctttaaagcgggcttgatttgatcaagagagttcataattgaaccgatttggtccataatatgcatgtaattaatcgtctcttcgtcgtttgtctgagaaacctgagaaacctcctcttgctgttcctccttctcttctgttggttttgctgcatcgccgaacatcattcttgaaaacacatccaactgcatacgcctcctttccatataccatactctatgagtaagatgaactgatagtttagacgaatatattgccatgtgaaaaaaaataggatagaattagtacctgatactaataattgatcacaacctgattgatcttctaaatttaagatataaaggagtcttcccttatgaaagctggaatacttggtgttggacgttacattcctgagaaggttttaacaaatcatgatcttgaaaaaatggttgaaacttctgacgagtggattcgtacaagaacaggaatagaagaaagaagaatcgcagcagatgatgtgttttcatcacatatggctgttgcagcagcgaaaaatgcgctggaacaagctgaagtggctgctgaggatctggatatgatcttagttgcaactgttacacctgatcagtcatttcctacggtctcttgtatgattcaagaacagctcggcgcgaagaaagcgtgtgctatggatatcagcgcggcttgtgcgggcttcatgtacggggttgtaaccggtaaacaatttattgaatccggaacctacaagcatgttctagttgtcggtgtagagaagctctcaagcattaccgactgggaagaccgcaatacagccgttctgtttggagacggagcaggcgctgcggtagtcgggccagtcagtgatgacagaggaatcctttcatttgaactaggagccgacggcacaggcggtcagcacttgtatctgaatgaaaaacgacatacaatcatgaatggacgagaggttttcaaatttgcagtccgccaaatgggagaatcatgcgtaaatgtcattgaaaaagccggactttcaaaagaggatgtcgactttttgattccgcatcaggcgaacatccgtatcatggaagctgctcgcgagcgtttagagcttcctgtcgaaaagatgtctaaaactgttcataaatatggaaatacttctgccgcatccattccgatctctcttgtagaagaattggaagccggtaaaatcaaagacggcgatgtggtcgttatggtagggttcggcggaggactaacatggggcgccattgcaatccgctggggccgataaaaaaaggtgaggtgcacacaagatgactaaaaaaagagtagttgttacaggacttggagcattatctccacttggcaacgacgtcgatacaagttggaataacgcaatcaacggtgtgtccggaatcggtccgatcactcgtgttgacgctgaagaatatccggcaaaagttgccgctgaattaaaagattttaatgttgaagattatatggataaaaaagaagccagaaaaatggaccgctttacacaatatgcggttgtggctgcgaaaatggcggttgaagacgcagatcttaacattaccgatgagatcgcaccgagagtcggtgtttgggtaggctccggtatcggaggacttgaaacactagagtctcaatttgaaatcttcttaacaaaaggcccaagacgggtaagcccgtttttcgtgccaatgatgattcctgacatggcgacaggccagatttctattgcattaggagcaaaaggggtgaactcttgtacggttacagcatgtgctacaggaacgaactccatcggtgacgcgtttaaggttattcagcgcggcgatgcagacgtgatggtcacaggcggaacagaagcgccgctgacaagaatgtcattcgccggctttagtgccaacaaagcgctgtctactaatccagatccgaaaacagcgagccgcccgtttgataaaaaccgtgatggctttgtcatgggggaaggtgcagggattatcgttcttgaagaacttgagcatgccctggcccgcggcgctaaaatttacggagaaattgtcggctacggctcaaccggagacgcttatcatatcacagcgccggcccaagacggtgaaggcggagcgagagcgatgcaagaagccattaaagatgcaggcattgcacctgaggaaattgattacatcaatgctcacggaacaagcacgtattacaacgacaaatacgaaacaatggcgattaagactgtttttggcgagcatgcgcataaacttgcggtaagctctacaaaatcgatgacaggccacctcttaggagcagccggcggtattgaagccattttctctatcctggccattaaagaaggcgtgattccgccgacaatcaatattcaaacacctgacgaagaatgtgatttggattatgtgcctgatgaagcccgcagacaggaacttaattatgttctcagcaactcattaggattcggcggacacaacgcaacattaatctttaagaaatatcaatcataatcaagccaaaccggctgcccttaaagggtagccggttttttttgtgcataggattaaaagaggaggcgatcacatgagtgtagaacaaacatatagctggctcaggaaggctgattcaatagatgatttggcgcattacattatcccgcttttttcaggtgcggagaaaaagaactggaagggcattctgggacaccttcagcatcatgggatgtttaaaaacataaaagagggtattcagactgtttccaagctgaaggaaaaaggtttttacggacatatccaaaaggaagaacagtacctcaaaaacaaatggcaaggtcctgatgtaccaattgtcacgctgccggttgatgaacgaaacaggagaatccgtttagagttcggatcaaaatcaggactcgcctttcaagacaaaatgttcctttttctttcgtcagatttagattttgggtcagtatctgcccttatgacgcatgagtatcatcacgtttgccggttagatcatctgacaaaagaggaaaaggatgtcacattacttgatacaatcatcatggaagggctggcggaatatgctgtttatgagaggttcggccgaagtcaaacggctgaatggacgacttggtatacaccggagcagcttcaggctttatatgaaaaaaagattgcgccccatcgggatatcaaacgggataatcgattatttccccagctgttattcggcaaaggatatcagccaaaaatgcttggatacgcagttggattcaatattgtaaaaaaatatttaaccgccagcaaggcaagcgccgcagacgggctgtccattcctgctgagacctttttggatgcaatgctttaaaaggataaaataatggaatttcattaataatattacatttatcctaaaaaattcttgattttgcaaaatgattgtaataatatacaactataaaatttttcgataattcaatattatttattatttctgaataaagggattgctttctcttgaaaacgtttgacaacaagaggggggaaaggggagctagcatgagcacacttttagaagtgaataatttaaagacttattttttcaggaaaaaggagccgatccctgcggttgacggagtcgattttcacatcagcaaaggcgaaaccgtcgcccttgtaggtgaatcgggctccggaaaaagcattacttctttatcaattatgggcctcgtccaaagctcaggcggaaaaatcatggacggctctattaaactcgaagacaaagacctcacctcattcactgaaaacgattattgcaaaatccgcggtaacgaagtatccatgatctttcaggaaccaatgacctcccttaatccggtgttaacaatcggagaacaaattaccgaagtgctgatttaccataaaaacatgaagaaaaaagaagcccgtcaacgagctgttgaactcttgcagatggtcggtttctcccgggcggagcaaattatgaaggagtacccgcatcggctgtccggcggtatgagacagagggtgatgattgccatcgcactgagctgtaatcctaaactgctcattgccgatgaaccaacgacagcgctggacgtgacaatacaagcccaggtgctggagctcatgaaagatctctgtcagaagttcaatacatcaattcttctgatcacacacgatttaggtgtcgtgtctgaggctgccgatagagtgattgtcatgtactgcggacaagtcgtagaaaacgccactgttgatgacttatttttagaaccgcttcatccgtatacagaaggcctgcttacgtcaattcctgttatagatggagagattgataaattaaatgcgattaaaggcagtgtgcctacaccggataatctgccgccggggtgccgttttgccccaaggtgcccgaaagctatggataagtgctggacaaatcagccttcgcttttgacacacaaaagcggaagaacggtgagatgctttttatatgaggaagagggtgccgaacaatcatgacagcagctaatcaagaaacaatcttagagcttcgtgacgtaaaaaatactttccgatccggtcaggcctttttcaaagaaaagtcggtgatgtaaaagcggtggatggtgtttcattttcgttaaaaaaaggagaaacactcggaatcgttggagagtcgggctgcggaaaatcgactgccggcagaacgatgatcagactgtacaaaccgacagagggccaaattctttttaaagggcaggatatttccaatctgtcagaggagaagctgcggaagagtgtccgcaaaaatattcaaatggttttccaagatccatttgcttcgttaaacccgagaaagaccctgcgttccatcataaaggagccgtttaatacgcacaacatgtataccatgcgtgaacgaaacgaaaaagttgaagagctgcttgcaagagtagggcttcacccgtcgtttgccagccgttatcccatgaattttccggcggccagcgccagcggatcggcattgccagagcactcactttgaatccagagctgatcattgcagatgagccggtttccgcacttgatgtatccattcaggcccaagtgattaacttgatggaggaattacaggaagaatttaatcttacgtatctatttatctctcatgatctgagtgtcgtacgccatatcagcgacagagtcggagtaatgtatcttggcaaaatgatggaactgaccggcaagcatgagctttatgacaacccgcttcacccatatacccaagcgcttttatcctccgttccggttacaagaaaaagaggatctgtcaaacgtgaacgcattgtcctgaagggagaactgcctagtccggccaacccgccaaaaggctgcgtattccacacaagatgtcctgttgcaaaatcgatatgcaaggaacaaataccagaatttaaagaagctgctcccagccactttgtggcttgtcacctttatagctaatgttgcccgcacagctttgagagggggtatgcacactacataaacaacagctgagaagaacgaacatttcaagagggggaatatctaatgaaaagacggaaaaccgcactgatgatgctaagtgtattgatggttctggccatctttttatcagcctgctcgggatcaaaatcaagcaacagcagcgcgaaaaaatcagcaggcaaaccgcagcaaggcggggatttggttgttggttcaatcggagcgccaacacttttcaactcattatattcaacagatgaatcaagtacagatattgaacaaatgatttacagctttttaacgaaaaccgatgaaaacttaaatgtcaaaatgtcactggcggaaagtgtgaaagagctggatggcggattgaaatatgacgtaaaaatcaaaaaaggcgttaagttccatgacggagaagagcttactgccgatgatgtcgtctttacgtacagcattccgcttaataaggattacaaaggagagcgcggctctaactttgaaatgctgaaatcagtagagaaaaagggcgattatgaggttttatttacgctgaaatacaaagaccctaacttctataacaatacattagacagctacgggattctgcctgagcacattttaaaagatgtaccggttgcagagcttgaagataacgaatttaatagaaaaaatccaatcggctcagggcctttcaaatttaaagaatggaaagacggacaatacgtgaagcttgttgccaatgatgattactatgacggccgtccgtatttagacagtgtcacgtataaaatcattcctgacgccaatgcagcagttgcccagcttcaggccggagatattgatttctttaacgtgccgtcaactgactataagacagctgaatcgtttaataatgtcaaagtcgtaacagatttagcgttaagctatacgtatatcggctggaatgagaaaaatgagctgtttaaagacaaaaaagtgcgccaggcgcttacgacagctttagaccgtgaaacaatggtgcaaaccgtattagatggggacgggaaggtcgcttatatccctgaaagtccggtttcatggaactatccgaaagatatagaggttcctaaatttgaatacaacgtcaaaaaagctaagaagatgctgaaagaagccggctgggaagatactgacggtgacggcatcctcgataaagacggtaaaaaattcgagtttacactgaaaacgaatcaaggaaataaagttcgtgaagacattgcagttgttgttcaagaacaattgaagaaagtcgggattaaggtaacgccgcaaatcgttgagtggagtgcattagtagaacagacaaatccacctaattgggactatgacgcaatggttttaggatggagtttatcaacgttcccagaccattacgatatcttccattctagccagtctgaaaaaggcttaaataacatgtggtacaaaaaccctgaagttgataagcttctcaaagatgcaaaatcaatcagtgaccgtaacgaatactcaaaagcttacgaaaagatttaccaaaaacttgctgaagatcagccgtataccttcctttactatccgaacaaccatatggcgatgccggctaacttagagggttatgtgtatcatccgaaacgcgagttgtaccaaattgaaaaatggtggcttgcccaataattttcccttgaaggggagggagtgcgtttccttcccctttgaatttgaaaaagaacaacgaaggggacaagaatatggttacatatattattcgaaggacgttatcttcgattcctattctattgggaattacaattttatctttcattattatgaaagccgctccaggggacccgatgacacttatgatggaccctacgatcagccaggcagacagggctcagtttattgaaaaatacggtctcaatgaccctgagtatgttcaatatttaaaatggctaggcaatatggttcaaggtgatttcggcacatccatcatcagaaaagggacgcctgtttcagaactgattttagcacggctgcccaacacactcctcttgatgctggtgtcaacaattttggcgctgatcatttccatcccattcggggtaatttctgcaaaaaaaccttattcgaagctggactacggcattacatttacttcatttatcggtttggcaatcccgaatttttggttcggtttgattttaatcatggtttttgccgtgaatctcggctggtttccaaccgggggagtcgccaccctgaactcagatttcagtatagtagaccggattcatcatttgcttttacccgcttttgtgctggcgacagctgatatggcaggcttaacgagatatacaagatccaatatgcttgatgttttaaatcaagattatatccggactgccagatcaaaaggtttcaaagagaatcgagtattatttaagcacggcttgcggaatgcactattgcctgttattacgattttcggcttaatgattccttcctttattggcggagcggttgtcgtagagcagattttcacttggccgggattaggaaagctgtttgtcgattcagcattccagcgcgattatccggttatcatggcaatgactgtgatctcggcggttcttgtcgttgtcggaaacctcattgcagacatcctttacgcgattgttgatccgcggatcgaatattaaaaggagggaaacagagatgtcagagctgcaaacaactccctcgccggagatcaggctgaaagaaaatatttcgaaaaagccagaaacaatgacaaagattttctgggaaaaattctcgaaaaacaaactggccattttaggtgccgttattctttttatcattattatgtcggctgttttcgcccctttaattgcaccttatccccaagagcagcaaagcctgcttgataaatataaggcgccgggccttgaacatctgatgggaacggataaatttggacgtgatattttcagccggatcctatatggagcgcgtgtctctttattggttggatttgcgtccgtagtcggttcgattttgatcggaacggttttaggagcattagccggatatttcagaggaatagtggatgctgtcattatgcgtgtagttgacattgtgttatccattcctgatattttcttgttgatcacgctggtcaccatcttcaagccgggtgtggacaaactgattttaattttctgtctcacaggatggaccacaacagcacgattagtaaggggagaattcttgtcgctccgttcaagggaatatgttcttgctgctaaaacaattggaacaaaaacgcacaaaattattttttctcatatcctgcccaatgcgttaggaccgattattgtgtcagctacgctgaaagtagggtctgttattctagctgaatcggcgctaagctacttaggctttggaatccagccgccaatcgctagctgggggaacatgcttcaagacgcacagaatttcacagtaatgattcaagcatggtggtacccgttatttcccgggctatttattttaatgaccgttttatgcttcaactttgtcggtgatggcctgcgggatgcgcttgacccgaaaaatattaaataaaaatgaatatcatatctgttataaaatatcaccaaatcagaaaaaaagcaggtctccttttgtcagaaaatatacaaagagatctgctttttgcgattcttacataaacccagtgattccagatttcctcaatctctttggaataatttctctatcccttgcctatactgtggacaacagtttttataaaagtgaggggttagagatgttatttcttcatgatgtgtgggtcaattggtttgaaggggaagaaaatggctacaatgtatgccactttcacgaatggcgcaaggaagatacggttgagcttttggatcaggtgccgctgttaagggtgccgtcagtactgtttcattacatagaaaacgatctgtcagagcttccgaaaggtttgcttgaagacgtacatcagaaatcgtacattcggaaaaatcatgagcggacaaagcttgagtattgttttgtcgtaacagacggaatcggcattttagctgtcgacacgatcggctacacgatccctgtcagaaaaagccgtctgatcccaagacaggagcagctcgtttatgaaatggtaaaagatgtagagcctgaaacatatgaatttgagccaaagaagctggaatcctccaaggaatatcacatcttatcattagcaccagaacatgtcagaggactgacaagaaaagaacggcaaattaagcagctgatgtttatggcgcttgaccaattaaaagggctgaaaaaccgagcggaaattggctactggtacacagagtggaatccgcatatgtatgaacaaatcaaaaggatgagctttgaagagatttgggacatgctgtataacgaaacaattgaaggctggtcggacaagcacctagccttttgcgaaaacctaataaaaggacagccttttttcgaaaagctttgggaaatggaaaacgaatcaaaggtcaactaaaaaaaccgctctttgcaaagagcggttttttgattagcgtctttttcttccaagacccatggcattctccatttttttcagcattttgtttgctgtccggttcgctcgttccgcgccttcatcaagaatccggtctaattcttcagattctatcagctcgtaatagcggtcctggatcggttttaatgcgttcaccacgacttctgccaaatcacctttaaactcgccgtagccttttccttcgtactttgcttcaagctcttcaattgtcgtattgccgaggattgaataaattgtaagaaggttggaaacgcccggtttgttttccttatcaaatttgacaatgccttcagaatccgttacagcgcttttgattttcttttcaagctgcttcggctcatccagcagggtaatataagctttctggttcggatcagatttgctcatcttcttcagcggatcattcagagacatgatgcgtgcaccgacttttggaattttcacttccggaatcgtgaagatgtcgttgtattttttgttgaagcgttctgcgagattccgcgtcagctcaaggtgctgcttttgatcctcaccgacaggcacaagatccgttccgtacagcagaatatcagcggccattagcggcggatatgttaacaggccggagacgacagcttcattgcctttggatttgtccttaaattgagtcatccgctcaagctcgccgatatatgcgacacactgcatcatccatccggcctgcgcatgcgcggggacctctgattgaataaacaatgttgctttttctggatcaagtccgacagctaagtaaagcgctgcgagattgcggatattctttctaagctcaagccggtcttgaggaacagttatcgcatgctggtccacgatgcaaaaatagctattataatcatgctgcagttcgacaaactgcttcattgcaccgatatagttgccgagcgtcactgagccgcttggctgaatgcctgaaaaaatcgtttgtttcatgaaaacatcaacctcatttcttaaaacataataaaaaaggctcattcttcccctgtaaaaaagggacgaatgaaccgtggtaccaccctgattattccattaaaatgaaatcactctgacgtttgtaacggagactgctccggctgagcctacttttttccagttcggtcagctgctccaaagtccattccacattgcccgttatctgctcccagcaccgcagactctcttcaaacaggtgaaatgtgtactactctttttcatagcaagcttttcttttgattgcttcattataaatcaattataaccaattgtcatcatgaaaaaacattctttttccagtaaaattgtaataatataaataacacgggtgctgtaaaatccttaaatgataactgctatcagcgtaaaaacaggcagatattatatgtaaaaagcaatatgggcagaaaacacatgaaaaagtttttaatcaatttatgctttaaatggtagaaggatattatgttcatggaagaaaaactaacgaagtttaaatattttaaattgataaaataatattgcaataaattatttgtttcattataatgaacttgttcactctattgttacagcttttttacaaaaataatcagaaaagacggaacagaataaaagttgtggaaactcaggttcatttgtctgatatttctgaggatttagccgtaaggagctgaaaattattattagggggtttgcgaatatgaaaaaacgttggtcgattgtcacgttgatgctcattttcactctcgtgctgagcgcgtgcggctttggcggcagcggatcaaacggtgaagggaaaaaggacagtaaaggaaagacgacacttaacattaatattaaaactgagccgttctccttacatccgggattggcaaatgattcagtatcaggcggtgtcatccgtcagacttttgaaggattgacacgtatcaatgcagatggtgagcctgaagaaggcatggcttctaaaattgaaacgagcaaggacggaaagacatatacatttaccattcgtgatggtgtgaaatggtctaatggagaccctgtaacagcacaagattttgaatatgcttggaaatgggcgcttgatcctaataacgaatcacaatacgcttaccagctctactacataaaaggtgctgaagcagcgaataccggcaaaggcagcctagacgatgtggcagtaaaagctgtgaatgacaaaacgctgaaggttgaattaaataacccgactccatatttcactgaattaactgcgttctatacgtatatgccgatcaataagaaaattgcagagaaaaataaaaagtggaatacaaatgccggagatgattatgtatcaaacgggccgttcaaaatgacggcatggaaacacagcggttctattactctcgaaaaaaatgaccagtattgggataaagacaaagtcaaactgaagaaaatcgatatggttatgatcaacaataacaatacggaactaaaaaaattccaagctggcgaacttgattgggccggtatgccgctcggacagcttccgacagaatccctgccgaccctgaaaaaagacggttctttacatgttgagccgattgcaggtgtgtattggtacaaattcaacactgaagctaagccattagacaacgtaaatatccgtaaagctttaacatattcgcttgaccgtcagtcgattgttaaaaacgttacgcaaggagagcaaattccggcaatggctgcagtgccgcctacaatgaagggatttgaggataacaaagaaggctacttcaaagacaatgatgtcaaaacagcaaaagaataccttgataaaggcctaaaagaaatgggcttaagcaaggcatctgatttgccaaaaatcaaattgtcttacaacactgatgacgcacacgcgaaaatcgctcaagcagtacaagaaatgtggaagaaaaatttaggcgttgatgttgagcttgataactcagagtggaatgtctatattgataagctccacagccaagattatcaaatcggccgtatgggctggctcggcgacttcaatgatcctatcaacttccttgaattgttccgtgacaaaaacggaggaaataacgatacaggctgggaaaatccagaattcaaaaagcttctgaatcagtcacaaactgaaacagataaaacaaaacgtgcagagctgctgaaaaaagcagaaggtattttcattgatgaaatgccggttgccccaatctatttctatactgatacttgggtacaggatgaaaacctaaaaggtgttatcatgccaggtactggtgaggtttatttcagaaacgcatattttaaataaggctacgtctgaaaataaaagacctcaaggtatatggggagaaaagccccatatacctttcttactgatggagtataaaaatgtaaaaaccatggaggtgttcccccttgctaaaatatatcggaagacgcttagtctatatgattatcacactatttgtgattgtaactgtgacattcttcttaatgcaagcagcaccgggcgggccattttcaggtgagaaaaagcttccgcctgaaattgaagcaaacttaaatacgcactatggcttggacaagccgctgtttgtacaatacgtcagttatttgaaatcagttgcaatgtgggatttcggaccatcatttaaatataaaggtcagagtgttaacgacctgatcaattcaggtttccccgtttcattcactcttggagcagaagctattctcctcgctttagcattaggtgtattgtttggagtcattgcagctctttaccataataagtggcaggattataccgtcgcgattttaacgatatttggtatttcggttccaagctttatcatggcggctgttctgcaatatgtgttctccatgaagcttgggctgtttccggtcgcggggtgggagtcctgggcatacacctttttgccttcaatcgcacttgcttccatgccgatggcgttcattgccagactttcccgttcaagcatgatcgaagtgttaaacagtgattatatccgcactgcgaaagcgaaagggctgtctcgtccagcagttactgtgcggcacgccattcgaaacgcgcttttgccggttgttacatacatgggcccgatggccgcccaggtcttaacgggaagttttatcattgaaacgatttttgggatcccgggtcttggttcccacttcgtaaacagtattacaaaccgtgattatacagtcattatgggtgtaacggtgttcttcagtgtcatcctgctattgtgtgtattaatcgtagacgtgctttacggcattattgatccaagaatcaagctttccaaagcaaagaaaggagcctaggccatgcagaacattccaaaaaacatgtttgaaccagccgcagcgaatgccggcgatgcagaaaaaataagtaaaaagagcctttccctctggaaagatgcgatgcttcgcttccgcagcaataagcttgcaatggtcgggcttatcattatcatgctcattatccttatggcaatttttgcgccggtgttctcaaggtatgattattcaactactaatcttttaaatgcggataagccgccttcaaaagatcactggttcggcacagatgatcttggacgggacattttcgtccgtacatgggtaggagcgcgaatctcaatctttatcggtgtcgcagccgctgttcttgatttgctgatcggtgtcatttgggggagcatttcaggcttccgcggaggcagaacggacgaaatcatgatgcgtatcgctgatatcctttgggcagttccttcattattaatggttatcttactgatggttgttcttccgaaaggtctatttacgattattattgccatgacgattacaggctggattaatatggccagaatcgtgcgcggacaagtgctgcagctgaagaatcaggagtatgtgcttgcttcacagacactgggtgcaaaaacatcccgtcttctgtttaaacatatcgtgccaaacgcaatgggttctattttggtcacgatgacactgacagttcctactgcaattttcacagaagcctttttaagctatttgggacttggtgttccggctccgctggcaagctggggaacgatggcttctgacggattgcctgcattgacctattatccgtggcgtttattcttccctgccggatttatctgcattacaatgtttggtttcaacgttgtcggcgacggattaagagacgcattggatcctaagttacgtaaataagggagtgatacgggtgacacgcctattagaagtaaaagatttagcaatttcatttaaaacatatggcggagaggtccaggcgatccgcggagtgaatttccatctggataaaggggagacgctggccattgttggagaatcaggttccggaaaaagtgtaacctctcaagcgattatgaagctgattccaatgcctccgggttatttcaaacgcggtgagatcctgtttgaaggaaaggatctggtgccgctgtccgaaaaagaaatgcaaaatgtccggggaaaagagatcggcatgatattccaagatccgatgacctctttaaatccaacgatgaaggtcggtaaacaaattacggaagtgctttttaaacacgaaaagatctcgaaggaagcggctaaaaaacgcgcggttgaactgctggaattagtcggtatcccaatgccggaaaagcgggtgaaccaatttccgcatgaattttcaggcgggatgagacagagggttgtcattgccatggcgcttgcagcgaatccgaaacttctgatcgccgatgagccgacaactgctcttgatgtaacgattcaagcgcaaattctggaattgatgaaggatttgcaaaagaaaattgatacgtccatcatctttattacacacgatcttggtgttgtggcaaatgttgctgaccgggtcgctgtcatgtacgcgggacagattgtagaaacaggtacggtagacgaaattttctacgatccgagacatccgtatacttgggggcttcttgcatccatgccgacactggaaagttcaggagaggaagagctgactgccattccgggcacaccgcctgatttgacaaacccgccaaaaggagatgcttttgccctgcggagctcttatgcgatgaaaatcgattttgaacaggagccgccaatgtttaaggtatctgatactcattatgtcaaatcgtggctgcttcatcccgacgcgccaaaggtagagccgccagaagcggtaaaagcgaaaatgcgtaaactggcaaatacgtatgaaaaacctgtcttagtgagagaaggtgaatgaattgactgaaaaactattagaaatcaaacatttaaaacagcactttgtcacgccgagaggaaccgttaaggctgtagatgatttatcatttgatatctataaaggtgaaacattagggctggttggtgaatctggctgcggtaaatcgacaacaggccgaagcattatcaggctgtacgaagcaaccgatggtgaggtgctgtttaacggtgaaaatgtgcacgggaaaaaatcgcggaaaaagctgctggaattcaaccgcaaaatgcagatgattttccaagacccctatgcatccctgaatccgagaatgacagttgctgatattattgctgaaggccttgatattcataagctggcaaaaacgaaaaaagagcggatgcagcgagttcatgaactattggaaacagtgggattgaacaaggaacacgcgaaccgctatcctcatgaattttccggcggccagcgccaaagaatcgggattgccagagcgcttgctgttgatccggaattcattatcgcggatgagccgatttccgctttggatgtatccattcaagcgcaggtcgtgaatttaatgaaagaactgcaaaaagaaaaagggctcacatacctgtttattgcccacgatttatcgatggtcaaatacatcagtgaccgcattggcgtcatgtatttcgggaaactggttgagcttgcgccggcagatgagctttatgaaaatccgcttcacccatatacaaaatcattgctttctgcgattccgcttcctgatccggactatgagagaaatcgcgttcgccagaaatatgatccgtctgtccatcaattaaaggatggggaaacgatggaattccgcgaagtcaaaccgggacattttgtgatgtgcacggaagccgaatttaaagctttttcatgattcatcaatccttcaagagatttctcttgaaggatttttttgcgtcttcatagaaagtgagaatgataacatttacaattagaggaaaaagcggaggcgaaatacgattcaatttctgcataacaaaaatgtttttgcgctattgctgtctcaatcttttcaatccttagcaggagtcctcgtcacaatcgttttaatggtccgggtctatcaaatgactgactccgtttttttggcgggccttattttatcgttcatgtcgtttgcgagtatagcagcaagcttttgcgtctctccggtgcttcgcattctcggttttaaaaaggtgcttgcgggagcgaatctgctgagagcggtctttacaatcctgatggcatacagcgtcactcatcacggacaggcattcttttggattacgctgctgtttgtgttttgtttttccttcgcgggcgctttttttcagccggcaagatttgcgctgctgccgattattgttccaaagaagcaatatgtaaaagcaaatggtgtgatcgccctctcgaatcaattgctcttaacagcaggctggggccttggaggccttctgacgtacgccgtcccttttgaactcgttgtcttcgctgccatttgcctgtttgttctatcgggagcttccatcagtgtgctgcatgtaaatgaagaagaggctgtaggaactgctgaaacagcatctgccagaagtatatggaaggatttaatgatcatccctattgtaagagacattactgtaatggacatgatagaagctttggcgggttccgtatggtcatctgctattctcctcgcatttactgcggctgttttgcatgaaacagaggtgtggtgggggatgtttaacgcttcctattttataggcgcaattgtcggcagtgtgattgccattcgtttttcttctttttttgagcggaatatgggctatgccattatgttcagctcacttgtaatgtcggcgctgacccttttgttttcattttctccagtcccatttttatgcgctctggcttgtgctgcaatggggcctttttatcaggtgcgtgatatttgccaggaaaccatgctgcaggaggttattcccgagcagaaacgaatcggaatcatggctgcaaaaaatgcgattttgactccttggtcaggcctcacctactccattatggggctagtagctgatgctgctgatgcgaaaatagcttttatcgcggctgctgcattatatatcataacatttctgattgcactggcgcagccccgcctggttcattacaggcgggaaaatcgagttcaatgagaaacaattcaaaatgaacggagcagatggctcggtttttgctgaaaaaaaatgaaaccatggaggaagttcgcacgtctttatagatgtaaggctgtttaaacaagaagaaatggggtatatctaaaagtatgaagacaacgaactcataaggagcaaatcaatgaactggtatgaaaagcttagcgagtactttccaattgaagaaatgaaatcaaaagcgcatatggaagctcttctgaaagagcgaagcgatatttaccataaagatgaaggcaaacatcatattttaatgtttgcggaattcgattcttttatcttcgttgattatctgtatgtgtctaaggatgcaagagggcaggggcttggcggcaaattgatcgcgaagctgaaaaagaaaaataagcccatattgctcgaggtggaacctgtggatgaagatgatactgatacagaaaaacgcctgaggttttatcaaagagagcatttcaagcatgctcagtcaattgggtaccggcgccggtcattggctacgaatgaagtaaacaagatggagattctgtactggtcaccaaaaacagaatcagaagaagaaattcttgaagccatgaaacaaacatatgaaaacattcatacttataaagacgagaaatggtacggggaatcgtacgaaaaaacggatgaagtcctgaaactcattgatgaagaaaaacaaaaaaatattttcgatcagttaagctaattgagaattagaacatatcatgaacattaaaaatttgctggattgacacatttttttcttaggatactgttcacacttacttttttatagtataatacctgtaaagattccttttttagagtaatttcaatttaagaataaaatagatgttcatcctactaattagaggagtgaagatgaatggttacactatacacatcaccaagctgtacttcatgcagaaaggcgagagcgtggcttgaggagcacgatattccatttgtagaaagaaacattttctctgaacctttatcaattgatgaaataaaacaaattcttcgaatgactgaggatggaacagatgaaatcatctcaacccgttcaaaagtattccaaaaactgaatgtgaacgttgaatctatgccgctgcaagatttgtaccgcttgatcaacgagcatccagggttgcttcgccgtccgatcatcattgacgaaaaacgtttgcaggtcggatataacgaagacgaaatcagacgtttcctgccaagaaaagttcgctctttccaattaagagaagcacagcgtttggcaaactaatagatcgtatcatcaaaagaaggctgagtcatcagccttcttttattatttttcaacctgctggtaataaatgctcgcaagaatgacaaacgcaaccgtcaaaatggggaggagcgtttcaactgtgccgtgctgcgccataaaaagcgacagctttttgtctctgacaatcatttctccgccagtataagcaagcagcccgcttcccgcgtaaatcagaagcggtattttctctagtgcaatatggatgagtttgctgccccaaataataaccggaaccgatacacacaaacctataacaacgagagaaaactcaccgtgtgatgctcccgcaactgcgatgacgttgtccagcgacataaagagatctgcaagcacaatcgttcgtatcgctctccacagggaggtgctgcttttaatgtgtttcgtgtcttttttttcaatcagcagctgatatcctaaatacagcaggaaaattccgccggcgcactgcaagaacggaatgttcaaaagatatactgctgcacttgttaatccgattctcatggcaacggcaataaatgttccgagaataatggcttgctgtctttgcttgtccggcaaatgtctgctggccatggcaataacaaccgcgttatctccgccgaggatcaggtcaatcccaacaatgacaagcagagaaatcagatagtcatgctccatgaagcggcacctcgctttcagtccttcgcttgtactactactatatgagacaggttgtattttatgatatcagccgcctgaactgccgttttttaggcaaaggtgcatttttatttcttttgtgactgttttatcataaaatagaaatacaaaggaattcacactggccttggttaaggttaagatgtggacggaatgggtaaagtgtagtaaagtacaattaatcgggagcttagatgtcccttcaacatcttatatagaagggaaggttggcaaatggaaattgaaagaattaacgagcatacagtaaaattttatatgtcttacggagatattgaagatcgcggttttgacagagaagaaatttggtataaccgtgagcgcagtgaagaacttttctgggaagtcatggatgaagttcatgaagaagaggaattcgctgtggaaggcccactttggattcaagttcaggcactggacaaaggattagaaatcatcgtcacaaaagcccagctttccaaagacggacaaaagctcgaactgccgattcctgaggataaaaagcaagaaccagcatctgaggatcttgacgccttgctggatgatttccagaaagaagagcaagccgtcaatcaggaagagaaggagcaaaagcttcaatttgtcttgcgatttggcgattttgaggatgttatttctctatctaatttgaacgttaacggaagcaaaacgactttatattcgtttgagaaccgatattatttatatgtagatttttgcaatatgactgatgaagaggttgaaaatcagctaagcatcctgctggagtacgcaaatgaatcctcaatcagcatacaccgtcttgaagagtacggcaagctgattatttcagagcatgctctagaaacgataaaaaaacactttgcatcatagcaaaccgatttccttccggaaatcggttttttttatgcacgaaaatgcattttagagatgtgaaaaatcaaaaacatatagacaagcggaaaatacagcgaacaggagttgatcatcttttccagaaagtatacttcatctggaaaggagagatgacaattgtttagtgctgtgactgaagacggccaaatgtttcaccttctaggcgctcagcaaaaccagaaattaaagcggagacggttcttctgtccggtatgcgggggagagctagctgtgaagcttggacttcaaaaagcgccgcattttgcccataaacagaacaaatcctgctccatagacatcgaaccggaaagcgcctaccacttagaaggaaaaagacagctgtatgtatggctgaaaacgcaacgggcttcaccaatattggagccgtatataaggacaatcaaccaaagaccggacgtcatggcaagaattaaggagcatatgcttgctgttgaatatcaatgcgccactatcgctccagatgtctttcaaaagcggacagagggcttcaaacaagaaggaatcatcccgcagtggattatgggatacagccgcttaaaacggactgcttcgtccttttatcagctttcagcttttcattggcagtttatcaatgcaagtccatacagagagctgatatgttattgtcctgaaaggcgttcttttctccggctcagctacatcattccattctacacaaaccattcctattcctcagtccaaacgatccctatccatcgggcaggtgcaggcgatctttttttcactgaaccgaaaccctcatttcaatattcaggctggacgaaagcgattcaccgttttcgccataaaccccatcggtttaactcaaaggaaataaatcgccttaggctgctgttttatgagaagcggcagacacccttttcttttctgccgactgaagtgtttgttcctgttagaaaaggggcagtttttaagagtccggtttttgtgtggcaggggtttctttatttgtttatgacggatcttggaggtaaacgtgcgccaattcgtttttcagccgttttgcagcagtgcaaactgcacattcataataagaacattgcactcaggttcgaatgcagcgaagagtgtctttcagaagcggttaaacagtatattgattttttgtgcaagaagggatttttaagggagactcagaaagaagtatatgtgctgaatcagcctgcaggcggcatacactccatgcaggatctcatagaaagagaccgcagctgttttatagaatgagtttgtcttatttggctcaccctaagacaaaggtggtgggcaggctgtgaaaggcacaaaaggaaaggtttttcgtgtttttactgcttttttggcattcgttctcttcattactgcatatgatttgacaaaaggcagtgaaaaaccggaagatattcacaacacaagtttattgagaaacagctgttttttcaattggcttgaatcaaagaagacgagggggatcaccatggctgaggaaaaaaaagcaaaccaactgcctgacagaagtgaggtaaaggcagaagacacatggagacttgaggatatttttcctagtgatgaggcctggaataaagaatttcaagctgtaaaagaattaattccgaatttatctaagtataaaggaaagctggcagattcagctgatcatttatacgaggctcttacgtatcaagataaagtgatggagcggctgggtaggctgtacacatatgcgcatatgcgctcagaccaggatactgggaactccttttaccaggggctgaatgacaaggcgggaaacctgtatacacaggccgcaagcgcgacagcttatttggttccggagattttatccatagaagaagacaaactgcagcagttcattcttgaaaaagaagaattaaagctgtactctcatgcgattgaggagattacaaaggaacgtccgcatgtgctgagcgagaaggaagaggcgctgcttgctgaagcttccgaggtactggggtcatcttcaaatacattcagcgtgttaaataacgcagatattacgttcccgtccattaaagacgaagatgggaatgaaaaacagatcactcacggcaattttattaatttcttggaaagtgaaaaccgtgaagtccgcaaaaatgcgtttgacgcagtgtataaaacgtacggacaatataaaaacacaatggccacgacgctaagcggcactgtgaaaaaggacaacttctacgcgagagtgaaaaagtacaagtccgcgcgtgaggctgcgctttctaacaacagtattcctgaggaagtatacgataaccttgttaagacgattaataagcatttgccgctcctgcaccgctatattgcgctaagaaagaaagtgcttgagcttgatgaagtgcatatctatgacctgtatacaccgcttgtgaaagatgctgggatgaaggtgacatacgaggaagccaaagattacatgctgaaaggcctcgcacctttaggggaagaatatgcctctatcctaaaagaaggactggaaaaccgctgggtggacgtttacgagaataaaggcaaacgcaatggggcttattcatcaggagcttacggcacgaatccgtatattttgatgaactggcataataacgtcaataatctctttacgctcgtgcacgagtttggacattccgtacacagctactatacgagaaagcaccagccttatccatacggcaattatagtatctttgtcgcggaagttgcctctacgacaaatgaagcgctccttggcgaatatttgctgaacaatttagaggatgaaaaacagcgcttatatattctcaaccatatgcttgagggcttcaggggaacggttttcagacaaacgatgttcgctgaatttgaacatctgatccatacaaaggcgcaagaaggcgagccgcttacacctgagcttctgacaaatgtctattacgacctgaataaaaagtattttggagacggcatggtgattgataaggaaatcggccttgaatggtcgcgtattccgcacttctattacaattactatgtgtatcagtatgcgacagggtacagcgctgcccaagcattaagcagccagattttgaaggaaggaaagccggcggttgaccgttatattgacttcctgaaagcgggaagctcacaatacccgattgatgtcctgaaaaaagcgggtgttgatatgacgtctccagagccaatcgaagccgcgtgcaaaatgtttgaagaaaaacttgatgaaatggaagagctgctgatgaaagtcaagcagtcttaaaaaagtaagcctgtgcggaaatgacgcacaggcttttttaaaaccctttaaaggttttccggtgattcaagcggtagagggtaaacaaaatagacagaaacagcagaggagaggtaatataaagcggcagcatatgcatcatgcctaagatattcaagcagaaaaaaacagcaatgcacacaattgagatcaaagtagacatcatggcggtcctcctcgtcctttttccttataaggatatgagtgaatgcacttcgttatgttttgtgacaaaaatatgaacattaagcatagaggttgtcaaaagtcgacatcttttgttatcataaggatgtgaaattgatcacaaacaaacattacccctttgtttgaccgtgaaaaatttctcccatcccctttgttgtcgttaagacatatgaaaccgcgcttatcccggcgcggtttctttagtgctaaaaacagaacgtatgtttggttcggggcgtaaaaaaacagcctcaagcatatgcacgcctgcggctatttttcacatgattgatattcatcagaataagtgctgagagacttccaaaacattccgtgtttggcttccactttggcaacctttttagcaaacgccagttttttcatttctttttctacctcttcaaggctcaggtcatatacaagagcaatttccttcgaggcaacgaagcggaaatattcaataaaacattctaaaggcggtgtttccgacggcttcggctcgtcgccaagcatctcaaataaaatttcttcatatacatcatatgagtagctgccaggaactttaagcccttcatcctcatgctgcgtattaaaaaacgtcagtgtcggattaacagaaacatccatctcagcagcaattttcatgtcacattgaagcgccttgaccgcactttgagaatgcagatcttttttgaattcttcaagatcgagacttgtattttcagcaatctccaaaagcacgttttcatccgtaatatttttctttgaaacaaataggctctcctgcatatttctgagaaattgcatgccggcttttcgtccttgcaattcggctgctttaaaagcgagagcagccatataaggcgatgaaagcggctgatcctgttcgaaccagacattgccgtcacatgacatgccagagcggctcgcgatcttttcccatgcttctgcgagaagatgcttttttcgctttttatttaaagcggtaaggcttgcggaagcgataatgcgtaaggtgaaaaaacgtccgtatctgattttcagctttttgatgacgggctctaaggaccagcattcaggacataaagggtctacaaacatataaatttcaagcggtttttttggatgaccgtggcaatgggcgaagtatagctcatgctgatagtttgtcaagatgatcgatcctccgcttccgtttgattcaccatatgccttgctgtcaactccagccggccaaacaaaaactcacgaatttcgccctccagccctacatggtccattgcgtccttcatacagctgagccacgcatcagctctctcgtttgtaattggaaagggaagatgccttgctctgagcataggatggccgtgctcctcagtataaagcggaggcccgcctaaatactgagttaagaattgcttctgtttcctggcggtttctgtcaaatcgcttggaaaaatcggcttcagcaaaggatgagacgcgacacgctcataaaaagtatcaacaagttgcgatagaagttcctctccaatcgcttcataaggtgcgttaaacgattgtcccatgttgactactcctttaaatatggctaataggaatcataaatcctattgcaaaaagtaattttctgtatttcattgtttcatctagatttattttagcaacaaggcatcatttctacaaacaaactgccttttatgcgtttgatgactcatttcggctgacagccggggtttgtatttcatatcatatcacataaaaatcaggaatgcgtaagatttcacttcgcaaaaaaaccagagggaaagagcacctctggttacgcgtaataagctgaagttatttttttacatagttttgcgtttcttggaaaggaggaatgcctccgtatcggtcaacattccccggtccggcgttgtaagccgctaatgccatagacacattgccgtcgtatttatccagcatttgttttaaatatttcgttccgccctccacattttgctgcggatcaagcggattggaaacgccaagtgagcttgctgttgacggcatcagctgcatgaggcccatcgcacctgctccgctgaccgcttttgcattaaagcctgattcctgtttgatgacggcgcggatcagtttttcatcaacgccatatttatcagcggcttttttaatcgtactgtcaatagaaaagtctcccgaactgatctgatttgcttcatgtttgtttgaagctgaatctgcagcagctgtttcagtgctttctgccgcttttgtgactgaacctgaattgctgctcgtatatgagttaagcccatacgctgaaagcagtgacggcgctgttgtattcgcgctgttcagcatgctgagcgggcttggcgatgaagaaggtgctgattgctgagatgtcagaccgtttgtatattggctgagcaaagagctaaaacttgaaagcgggctttccgtattctgagtgtccgagctgctgcgtgcattagatatggactgtagtgcctgaagctgaagtaaagctgcccaattcgttacattcacgatgtcattccaccttatatagactttcgtttttcttcataaaaacgcagaattttatttttggtttcgcgctgaggaatgctgaattgctgaagcagcttctcgaaagcttttctgccctcatgccaatccgccgcctcaaattcaatttcatagtcctctttatttaaatatcggctgtggtctaaaactattaagcctttttctgtttctttttccgcacggtttgttgctaaagatccaaagtattgaatggcatccgtatcgatctgaagcttgtgcagctggtccttcacagggccctcgggaactgaaaatccagcgagatctgatacctctgaaagctgctggtgcgtttccagaagccccacatcagccggctcctttaatgtaaggacatactttccgttttttctgcggatacgaagcgcagcttgtttttgtttcagcgcgaagctgtctgtatcaaaataatgattcttttgatctgtaaaatctttttctgtcagctggagtgccgctgctatgtttttgaattcttgtttggtcagcatgtttttaaattcgatttcaatttcttggctcataatgctcttcctttccgccctgtaaatcttatttttactattatctctttagatgttaggtttatcaatatcgagctcgatatgataaaatgaatctgtactttgtttaaaaaaggagatcattatgcaaaacagaatcgaaattttgaatgcaacattatcggatgatcagcttcgccttgcctgtcagacagaaggaaacgaagcggaacgcaagccgtcaggtcaaatgcttgttgattctgaccactttgcttttgtatacatacttgaattagctgattcttttgaatatgtcattataaaggaacatgtatggccagaactgaagcaggcccatgcacaaaaaacaccggttgttttagaggcaggagaccaaacaattgaactggcaggcctgcatgaggagctggaatatcttttagaaaatataaaagataatgcaaactatggagaagaaatggaagaaaaagtgaaacgcgtgtttttatagaaactggttcggaattgggggatgtatgatggatgacaaacaatgggagcgttttttagtgccgtatcgccaggctgtcgaagagttgaaagtgaagctcaaggggatccgcacactatatgaatacgaggacgaccattcaccgatcgaatttgtgaccggacgcgtcaagcctgtggccagcatacttgaaaaagcgagacggaaaagcataccgctgcatgaaattgaaaccatgcaggacattgctggccttagaatcatgtgccaatttgtcgatgacatccaaatcgtaaaagagatgctttttgccagaaaagatttcaccgttgtggatcagagggattatattgcggaacataaagagagcggataccgatcataccatcttgttgtgctgtaccctttgcagacggtatccggagaaaagcatgttctcgtagaaatacagatccgtacactggcgatgaatttttgggcgaccattgagcattcattgaattataaatacagcggaaacattcctgaaaaagtaaaactaaggcttcagcgcgcttctgaagcggcttcccggcttgatgaagagatgtcggagatcaggggtgaagtacaggaagctcaagctgccttttcaagaaagaaaaaaggaagcgagcaacaataggtaaaggggaagaagagcatgaaatttgccgtatcatcaaaaggagatcaagtttctgatacgctgaaaagcaaaatacaggcgtatttattggattttgatatggaactggatgaaaatgaaccggaaatcgttatttcagtcggaggcgacggaacgcttttgtatgcttttcacagatacagcgaccgcttggacaaaacagcatttgtcggcgttcacacaggtcatctgggtttttatgccgactgggttcctcatgaaattgaaaaacttgttcttgccatcgcgaaaacgccgtatcatacagtcgaatatccgcttctcgaagtcattgtgacctatcacgaaaacgagcgggaagaaagatacttagctttgaatgaatgtacgattaaaagcatcgaaggaagccttgttgctgatgtggaaatcaaagggcagctctttgaaaccttccggggcgacggcctctgcctgtcaactccatcaggcagcacagcctacaataaggcgctgggcggagcgattatccatccgtctatcagggcgatccagcttgcggaaatggcttcaattaataaccgcgtgttccgtacggtggggtcacctctgcttctcccatcccatcatgattgcatgattaagccgagaaacgaagttgactttcaagtgacgattgaccacttaacccttctccataaggatgtaaagtcgatccgctgccaagttgcatccgaaaaagtgcggtttgcgagattccgtccgtttccattttggaaaagagtccaggattcgtttattggaaaaggtgaatagaaagaggacatatcgtggagcatttttttatcagaaagaacattacttccgctgaggacgggatgactgtaaaggaatatgccggtgaactgggaatttcgaaacgtctgctgaccgatattaagtttggcgggggagacctgcagattaacggtgagcatgtgacggtcaaatacgttttgaaagagggagatcttcttatcgtgaagtttcctgaggagcaggtgagcgagacgctgttggcagagcctgttccgctcgatatcctttatgaggatgaacatgtgcttgtgataaacaagcagccgtatgtgtcatcaatcccttcgagagagcacccctccggcagcattgccaatggaattattgatcattatcaaacaaccggagtgagggcgacagttcatcttgtcacccggttagaccgtgatacatcaggtgtcatgcttgttgccaagcatcgatttgcccactccattttatcgtctgcgcaaaaaaacggccttgtgaaacgccggtatgcggcagtggttcacgggcggatggcacagatggagggaacagtcgatgctccgattggcagacatcctgacagtataattgaacggacggtaacaccggacggccagaaggctgttactcatttttacgtcacatgtgcaaatgacgacatgacctcggtgacgttgcagcttgagactggacgaacccatcaaattcgtgttcatatgagttatctcgggcacccgttgtgcggcgatacactgtacggcggaacgagacaggaaattggccggcaggctctgcacagcgagcatctttcgtttatccatccgctgacacagaagaacatgacgtttcatgctccactgcctcaggacatgagaaaactgataaaaggagagaatcattgattctctccttttttatatggggcgaaatcttgattcgtcgtaaggcagggagcttggaacagagacggtttctatttctggaaagcgaaagcctgtcagttgatttccgaacacgcagcctgtatcaatgttgatggtgcgattgaccttccgaggctctttcacaggtgtatgaccgtataccacccaagcctttccgttataggctgccgcccaatcacgtctgacgggtctgccgtccggatatgtttcacccgtcacgtcaccgtaaagcacaaagtccttcactctgcgggtatatttgccgatatcgtcagctcttatgccagcatgggcgacaactaattctccattatgtaagatgtcgtaaagcggcgctgtttcgtacagcttcataaactgttcgctgactgcttttctctcatccttggaaagttcctcaagctctgctgctgttgtttcgagaccatgcatcacttttaccggatttccttttaagtaacgatataatttattgcaatggtttcccgggacataacgcacagcgcctttttcgtaagcgccggctacaaatcggatgacctctatcgatttgggccctctgtcagttaaatctccggcaaaaacaagcaccctgccttcttcatggacaggtactccatttttgattgtatagccaagcttttggattaatgcagtcatttcgtcatagcagccatgaatatcgctgatgatatcgtaagccatgcggtatcctccttaccgattgttttatttattatgaagcaaagtgttgtgagtcatcacaagcttttatgtgcaaattatagaagaagaatcattttctaaacaggattaagaccttatcactttatttttcatcatcacccttgttaaaatcgcgttatgttttttaaaaatgaggttttgttctctgagtgagaactagcataaccctgacttaaaaaggaggttctgattatggcgcatacatctgtcgcatctttagttgttgtacttatcgttgcatttttgacacccatccttttgcatcggtttaaactcagcatcccggttgttgttgctgaaatcattatggggctgataattgggaaaagcggccttaatttagttgtggagggtgacacctggctccagacactctctatgctcggatttatctttttaatgtttttaagcgggcttgaaattgatttttcgtcgtttgagaaaggaaagaaaaagcagttcctgccgaatggcaaggaagcgccgaatacgtttgctgcggcatctgttattttcgtcggtatttttattttatcattgctcttgtcctatgggttcgtcttggccggatttatccaaaatgcatttttgatgaccctgattatttcaacgatttcattaggcgttgtcgttccaacattaaaagaagaacggatcatgaattcgaatatcgggcagattattttgcttgttgctgttattgctgatttggccacgatgattcttcttgctgttttttcttctttatacggagaggacagcggaaacatgtggctcctgatgattctgtttgcggccggagtggtgctttactttttcggccgggtcttcaaacatcgctcttttgttcaatccatgtcaaaagggacgatccagatcgggacgcgtgccatttttacgttaattattgtactcgttgccctgtctgaatcacttggggcggaaaatattctcggcgctttcttagcgggggttcttgtttccctgctttcgccaaacaaagaacttgttcagcagctggactcattcggttatgggttcttaataccgattttcttcgtgatggtcggtgtgaagcttgatatttggactcttttccaggataaaacaattttaatcatgattccgctcctgctgctggcgctgttagtcagcaaaatcattcctgtcatgtacttaaagaagtggtatgataaccgaaccattttcgcgtctggtttcctgctgacatcaacgctttcgctcgtgattgccgctgcaacaatcggccagcagcttcacgtgatcagtgcaaatatgtcaggagcgctaattttagtagctgtcattgcaagtatttttacgccgatctgttttaaaaaattatacaaacgggaagagcagccggaggagaaaaagacgattacgttcattggcgccaatcaaatgactttgcctgttacacttgaattgccagaggaagagtatgacgtgcgtgttgtacacgtctaccaagagaatgcggaggaaaagctgtcagaatcagtgtttgctgttgaaacaatttctgactatgaacacgagacgcttgaatcactcggcatttttgaaacggatattctcgttgtggcgaccgggaaagaagatatgaatgcagacattgcattacttgcaaaagaaaaaggcacagaaagagtcattgcaagcgtaggatcaccggagcatgaagcagctttgaaggagcagggaatcagcatcttttctattctgctgtcgacaaaaacgctgcttcgcgcactgatagaagcgcctggcgtcatgaagctgctcacgaaccaagagtcttcgctgtatcaaattaatatggagaacagtaaatatgatggtgtcattttacgggaattccctttaacaggcgacgtcatctttgtcaggattttcagaggtgtggacagcattgttcctcatggggatacaaggctgaaattgggagatcgcttaattgtcaccggatctcgggggtacgtaacggatcttaagaaaacattggaaggataaatcttgaccaaataaggattcgtgttaatatagaggtgcagaacaattcaatatgtattcgtttaaccactaggggtgtccttcataagggctgagataaaagtgtgacttttagaccctcataacttgaacaggttcagacctgcgtagggaagtggagcggtatttgtgttattttactatgccaattccaaaccacttttccttgcgggaaagtggtttttttattttcagaggggaatgatttgtgaagttttcagaagaatgccgcagtgcagccgcagaatggtgggaggggagctttgtccatccgttcgttcaaggaatcggtgacggaacgcttccgattgaccgttttaaatactacgtacttcaggattcctattatttaacgcattttgcaaaggtgcagtcatttggcgccgcttatgcgaaggacctttatacaacggggcggatggcaagccatgcccaaggtacatatgaggcggaaatggcgcttcatcgggagtttgccgagctgttggaaatcagcgaggaagagcgtaaggcgtttaagccgtctcctactgcgtactcttatacatcccatatgtaccgttcggttttgagcgggaatttcgctgaaatcttagcggccctgctgccatgctattggctctattacgaggttggtgagaaattgctgcattgtgatccggggcatccaatttatcagaagtggattggcacatatggcggtgattggtttagacaacaggtcgaggagcaaatcaaccgctttaatgagctggcggaaaacagcacggaggaagtgcgtgccaagatgaaagagaattttgtcatctccagctactatgaatatcaattttggggaatggcctatcgaaaagaaggctggtctgacagcgccataaaagaggtggaggaatgtggagcttcacgccataacggatgacagcaagccggtagaagagctagcgagaatcatcattacgattcagaatgaagttgattttattcatattcgggaacgttcaaaatcggcggcagatattttgaaactgctcgagcttatttttgaaggcggtatagataaacgaaaactggtgatgaacgggcgcgtggatattgcgcttttctctactattcaccgcgtgcagctgccaagcggcagcttttcaccgaagcaggtcagagccagatttccacaccttcatatcgggaggtcggtgcattcacttgaggaagcggttcaagcagaaaaggaagacgcggactacgtgctgttcggccatgtgtttgaaacggattgcaaaaagggtcttgaaggcagaggagtatctttgctgtcagatatcaaacagcggatttccatcccggttatagccatcggggggatgacgccggacaggttaagagacgtaaaacaagcaggggcagacggcattgctgttatgtcaggaattttctcttccgctgagcccttggaagcagccagacgatattcccgcaagctaaaggagatgcgctatgaaaaggcattatgaagcagtggtgattggaggcggaattatcggctccgcgattgcttatcatttggcaaaggaaaacaaaagcaccgcattgtttgaaagcggaacaatgggcggcagaacgacaagtgccgctgccggaatgctgggcgcccatgccgaatgcgaggaacgtgacgcgttttttgatttcgctatgcacagtcagcgtctgtacaaaggtcttggagaagagctttatgcattatccggtgtggatatcaggcagcataacggcggtatgtttaagcttgcattttctgaagaagatgtgctgcagctgagacagatggacgatttggactctgtcagctggtattcaaaagaagaggtgttagaaaaagagccgtatgcgtctggtgacatctttggtgcatcttttattcaggatgatgtgcatgtggagccttattttgtttgcaaggcatatgtgaaagcagcaaaaatgcttggggcggagatttttgagcatacgcccgtcctgcatgtcgaacgtgacggtgaagccctgttcatcaagacccctagcggagacgtatgggctaatcatgttgtcgttgccagcggggtgtggagcggaatgttttttaaacagcttggactgaacaatgcttttctccctgtaaaaggggagtgcctgtccgtttggaatgatgatatcccgctgacaaaaacgctttaccatgatcactgctatatcgtaccgagaaaaagcggaagactggttgtcggcgcgacaatgaagccgggggactggagtgaaacaccggatcttggcggattggaatctgttatgaaaaaagcaaaaacgatgctgccggctatacagaatatgaaggtggatcgtttttgggcgggactccgtccgggaacaaaggatggaaaaccgtacatcggcagacatcctgaggacagccgtattttatttgcggctggccatttcagaaacgggatcctgcttgctcccgcaacgggcgctttgatcagtgatctcatcatgaataaagaggtcaaccaagactggctgcacgcattccgaattgatcgcaaggaggcggttcagatatgatgctacagctgaacggtaaagacgtgaagtgggaaaaagacacaggtacaattcaagacctgctggcgtcgtatcagcttgaaaataaaattgttatcgtggaaagaaataaagaaataatcgggaaagaacgttatcacgaggttgagctttgtgatcgtgatgtcattgaaattgtccattttgtaggaggcggatgagcatgttaacaattggcggaaaatcatttcaatcaagattgctactgggcacggggaaatactcatcgtttgacattcaaaaggaagcagtagctgtttctgagtctgatattttaacatttgctgtaaggagaatgaacatctttgaagcatctcagccaaattttctggaacagcttgatttatccaaatatacgcttttgccgaatacagcgggcgccagcactgctgaagaagcggttcggattgcaaggctggcgaaagcgtcaggcctttgtgacatgattaaagttgaagtcatcggatgcagccgttccttgctgcctgaccctgttgagacattaaaagcgtctgaacagcttcttgaagaaggctttattgtgctcccgtacacgtcggatgacgttgtgctggcgagaaagctggaagagctcggcgttcatgccatcatgccgggtgcatctccgattggatcaggacaaggaattttaaatcctttgaatctgtcatttattattgaacaggcgaaagtgccggtcatcgtggatgcgggaatcggctcgcctaaagatgcggcatacgcaatggagcttggagcggatggcgtactgctcaatacggctgtatcgggcgctgacgatcctgtgaaaatggctcgtgccatgaagctcgcagtggaagcagggcgcctttcttatgaggcgggccgaatcccgcttaagcaatacggaacggcaagcagtccgggagaaggtcttcctgtatgacgggcaggtattcaaggcaggagctgtttgctccgatcggcccatccggccagaaaaaattgaaagaagcgcgcgccgtgattatcggcgccggcgcgctcggaacagccagtgcagaaatgctggtgagagcgggagtcggctctgtgaaaattgccgacagagattatgttgaatggagcaacctccagcgccagcaactttatacagaagatgatgtcaaaaaagaaatgccgaaagcagccgctgcggagcgccgtctccgttcgattaacagcgatgttgatgtgaccggccttgtcatggatgtgacagcagaaaatatcttcgagctggttagggatgcatcgattattgtggatgcggctgataattttgaaacccgcctgatcgtaaatgatgctgcggtaaaggaagggattccttttctttacggtgcctgtgtagggagctacggcctcacctttaccgtggtgccgggttctactccttgcctgcattgcttgctcgatacacttccggttggcggagcaacatgtgacacagccggcatcatcagtccggctgttttgcaggtagcagtctttcaggtaacagatgcactgaagctgctgacgggagaggagtgcgagccggtgctgcgctcctttgatttgtggaaaaacgagcggtcagaagtgagagcggccagtctcaaacatgacgcatgcccaagctgcggcacaaaggattttccgtttttatcttatgaaaatcaaacaaaagcggctgtattgtgcggcaggaacacggtgcagatcagatcatctattacgaaagaagcggatcttgaagcgcttgccggtcagctgaggcaggccgggcttgaagtagctgcgaacccgtatttaatttcctgccgctcggatgatatgaaaatggtgctgttccgggacggcagagctttgatccatggaacaaatgatattgcccgggcaaaatccatttatcataaatggatcgggtaataaaaggagtgtagtgtaatgagtatatataaagcattgacaatcgccggatcagattcaggcggcggcgcagggatacaggctgatattaaaacctttcaggagcttgatgtattcggaatgtctgcgattacagcggtaaccgcacaaaatacgcttggcgttcatggggtgcatccgctgactgtagaggcgttgagacagcaaattgacgctgttgctgaggatttgagaccggatgcagtcaaaacgggaatgctctggaatgccgacatgattgaagaagtggcaagaaaaattgacgagtacggattcaatcgtgtaattgttgatccggttatgatcgcaaagggcggggcatccttgctgcgtgatgagtcagttgccaccttaaaggagttgctcattccaagaagctacgcgattacgccgaatgtcccggaagcagaaacgctgacaggaatgacaatcagctcgctggatgaccggaaaaaagcagcggagcagctcgtcaagatgggtgcgcagcatgtcattatcaaaggcgggcaccagcctgaggacaatcacattactgaccttctttttgatggcagcatgtttatgcaaatcacccatccttatatcaatacgaagcatacgcatggcacaggctgcacctttgctgcggctttaacggcccaaacggctaaaggagacagcatccatcaggcatttgaggttgcggccaactttgtccgtgaagcggtggaaaatacgctcggcatcggatcgggacacgggccgacaaaccatttcgcttttaaacgaaacagcttaaatacaagccgatgagatcaccagctgatggtgatctcttttgcgtttgctacggtatgcgcttttcatctggacaaggttatgatatgataggaattaagatcaggtactaatactatgtctttattaaatataggaggctttatacatatgaatttttcacttgaaggccgcaacattgttgtgatgggggtagccaacaaacgcagcatcgcctggggcattgcgcgttctttacatgaagcgggtgcacgtttgattttcacatacgctggtgaacgcctggagaaatccgttcacgagcttgccggaacattagaccgcaacgattccatcatcctcccttgcgatgttacaaacgacgcagaaatcgaaacttgcttcgcaagcattaaggagcaggtcggtgtaatccacggtatcgcgcattgtatcgcgtttgccaacaaagaagagcttgtcggcgaatacttaaacacaaatcgtgacggcttccttttggctcataacatcagctcatattctctgactgctgttgtcaaagcggcacgtccgatgatgactgaaggcggaagcattgtcactttgacgtaccttggcggagagcttgtgatgccaaactacaacgtcatgggtgtagcaaaagcttctcttgatgcaagtgtgaaatatttagctgctgacttaggaaaagaaaatatccgcgtcaacagcatttctgccggcccgatcagaacattatctgctaaaggcatcagcgatttcaactctatcttaaaagacatcgaagagcgtgcaccgcttcgccgcacgacaacacctgaagaagtgggcgatacagctgcgttcttgttcagcgatatgtcccgcgggattacaggtgaaaatcttcacgttgattctggtttccatatcactgcccgctaagcaggatctatatcaagcaatcccgaatagggattgcttttttatttcttctgattttcagctttctgtcatatagatagaatatgacacaatcggagggatgaagatgtctaataagaaaagaaacgcggataaaaaaccgctcatgtatattgttcagccggattatgcagaaactacaaggtcatccatgcaggagattgtcatcaaaagaaaggccgacaaacccgctccgccaaaagctgaggaaaagccggcttaccatgagaagcagcaggaggaagctgtggcacaggatgtcctgcaagaagaccaaaagcctgcagccgaaccagtgagtcagcaaacacaagaggcgagagagccagagaacataaaaagccaagaggaagaacagaaagcagagccgcaggccgtagaagaaaccgttgaacacgagcccccgaaagcagaaaaaaaggaagagcctgcacttgagacccggaagcctgagaaagaaccggaagctgtccatagtgctgataaagcggaggaaaaagcaccgccggcacgaaaagtgaaaaaaccgatgagcaagatgacgatccacgaaaaaattgattttttaacaaagctgcctcataacatgccgagagcgctttgtttgattgaagccaatggaagaacgtatagaggcgtgattgtcggaagaagaaatgattccgtcctgcttcgaacaaccggaaacggagccccaaccgagctggcaatcgatgatattacctctctgcacccgctcggtttttaacgaaaaagaaaaaagctgcccggctgatgttgccggacagctttttttacatagagaaaagcctgcaggcctgcaagcttttccagcttatgattaatgatgatgtgtacgattgattaatcgaggatttaagcagttgattgcgcagaagcagtctaagtcaacttcaatacagtagttcgttttttcgagtcggaacacttcacacaccgtatctttatcggtgaagtccaaaatgtgtttgtgttcgtcaaatgcgattaataatgacagtgttgcgcagcttccatgcactctttcgaccctgaaaaatactgtattaaagcaagggccgttatcgagttcgccgacatttccgaaggcgactaatggcgttgattttgatgtaaatattgcaaaaggcactgtgtcgcctaacgaatggcttacagataaaagcttagagtggcagccggtcgggcagtcttcttcaacagcgttttgcagatcttcaatattttctacagcttcacgcacgcagcttgatgttttctggctcatattatccctcctgccttataaatttgagactggcgaaatgatggagagtcagctgcctcacgctggaagcagctgaatgatttgcacctgtaatagagtttggaaggggattcctctttacaagtgtttatccattgtgatgatgctttttatctttgtgaggcgatgttctgtcaactagctctggtgacaggcactgaatcgcgcagaagcatccgagatccacttcaatgcagaaatctgttttttctagcccgaagaaatccgggtcgcaagggtggcaaacacttaaggtatcgcctttgacatcgaccgggcgtaaaatagaaagtgttgcacagcaatcgcataatttttcgacgcggaagaaaatggattcaaagcattgcatatcatccacaaatccccctacgtttccgaatgtggagaacaatccgccttttttatcaaaaacgagaaacggaattgtgtcttttccagcaatcgtagggtttaaaaggttggtatagcagccagtcggacactgttcttcaactgcctcctgctctgctaaaatcttttccactgcatcgcatacacagttctcatgccggccatgggtttttccgcagctcattgatttcagctccttctttatagggtatttgactttagtccttaacaacatatgtacccgtgccccacttggtgtgggtgaacgtctatatattcatcatatgcttggaaaataagaaaaagcagagcgtttttagctctgcttttaggttctaaaggacaagagtgattgttaagagggcgactaagaggtttactgctgtagaaacaactgttgcaatatcggcatctactgttgtgacatttacaccgcgagaacattcgataagaagtttttggcgatttacttgtttgtttgatgcaatctgtaataaatcttgtgcaactaattctgcaattacgccatctgcaatggatgtgagagttaatattacggttgctgaatttagcgctgttaaaactgaagttattgcttgaacgtctgtagatgaaacgttaatgtcacatgagtctctgataataattgtctcatcggagatctgtttgttgagatttgcctgagccagattttggtcaattaaggcattgtcattgccaaaaaacccgttaccattgcagcaaatatcgcaattgcattttctttcttcttttttatctttttcgtctaacggatggtcacagtcaggatcaagtgcaacccaagaatatggtctgctttccatatctattcctccttttcttttactgttattaaatgagcgagcctcttactttgactgagtcatatatcatgatgaattgccctattttttataattaatttgagttgttattgttttgccgtctttgtctgagctgttcaattaattgctctctgcggctgagaggcttttcgtttctttgctcttgcacggatgcttcttcttttttcttcttttggctatctattaatgcttgtgatttagcttgtaagtcttttacaagatttaaaagcatttctttttcttcgtctgatacttttttcattttgtcttttgtgacaccatgtttagaaaatatattttggaccagcattttcgtcatcggatcagcttctggaagcttttcaagctcttctttgatcttatcgttatctgacatttgttttcacctcgtcttttaagtttgtgaaaaagaaagggttaaaggacgtcaagttcattgagaatgctgtttaacacctgaagcaagatttgtacaaaggttattatctcgtcggcagacaaagtaattttgatgtttcggctgttgattattttaatgatggttctttttttgatttgggagctatcgagaataagaatttcacttgccactgcgtcagccaaatcctcgtcggcgatgaccagctgagtcgccaggataatcatagttgtcacaaaggcttgtatagaaagggcagctgttacatgtgacgtatctattgtgatattttcgcagtcaatcacttcgatctgctgttcgaattcgcttgataattgctcaaatattgcagggtgcagggattcgactttttcttcaaatgacataaccttcactcctttcttatccatactctatataatgcaaatggggtgcagagcggaataataaaaataaccaattttctgccggacaagatacaattcatgaagaatagggttttcgcatatatgtgaagggatcatgattggcaaaggagtgaacgagtggttataaatgggctgacaattgttcttctatcgcttgcggtctttcggctcgcccgcctgctggtgtttgacacgattatggcgccgcttcgcagtctgtttcatgaagagaaggaagaaaaggatgcggacgggaacattgaaacctttatcgtgattaagggaaccggtgtcagggcgtttattggtgaattgctgagctgctattggtgcacaggcgtgtggtgtgccggctttttgattttatgccaggcggtgatcccgcaagcggcgcagtggctgattttacttttggcgatcgccggccttgccggcattatagaaacgctcgtatcaaaatggctgcaagaataaggcgttaccaccagcaactttctgtcagaatacgcataaagtagcatatatgacataaggaaaggaaggggacaaaaatgaatcagcatcataaacctccccaaaaatctccatatacagattcatcgtatcaatcaaaaaagataaaaaagaaaggctgcgggtgcggaaataaaaagaaaaagcctcaatagcctggcaaagaaaccggagaactccggttttttgtttttttaacgaggcggtctcgctcagcatatatcataagcgggggataaaagtgaatgagtttgaaaaatggatagaaggaagatatgaaccacacgaacaaaagcaaaaaaagcatgaagacacgatgggcagtatcagaaaagacttggatgcatttgataaagccggtctggaatttgaagatgagattgaagagctggctgaaaaaacggaggccttacttaaaaaacatcaagctcaatatgatcaatcgtaaatccgcaaacgccctatgcgaatatccaagccgatcccagcagctcacatagtgtatagagagtaaaggaggtgcttatctatgggctttggatacggattcggcggcggctacggcggcggctgttatggcggttatgctggcggttacggcggcggctatggttcaacatttgttttgttggtcgtattattcattctcctcatcatcgtaggtgcatctttcttttaagatgtattgaggaagtacgggttataacccgtgcttccttgccttgtgtttatttttaaaaatgttggaaaagcacattgtattatgtgcattcatacaataccgtattactccgccaaaaggaggcgcattatggataatcaattttttaagaacatcgaaaagaaaacaggtgtgaagatgcaggatgtaatgaatcttgccggatcactccaaaacgctaattttaaagatgaaaatacagtgcgcagtgtgattaaccgcgtagcgcagatggcaaacagacgcgtgccaaaagaattagaagataaaattgtggaatctattacaagcggaaaagaaaagcttgattttggcacgatttctaaaatgatggataataaataagtggatggcctggctgactcactgcagcgggcctttttttacagtaaaaacccggcagaaatctgccgggctgttaatgatgcaagggctgtcttgctttctgtagcaggggatacaaaaatcttgagcggttggctgttttgccgcgcctgttagcggggcaagacaaatataaatgctgtttcgcccgggtcatggctacatataaaaggcgtctttcctcctcaagagcggcctcgtctccttttcttgccgtttctaatgagaaatcgtgcggaatcgagccgtctacagtgcctaacacgtagactgttttgaattcaaggccttttgaccggtgaatggtcatcagctgaacgccatgttcatccgttctgtttttctcagcggccctcatatggtctacgtgggcaagaaagtcaggaatcgttttgaacttcttggcgacaaccttgatgtcgcgcaggtcatcggaacctttttccagcttgttgccctcattgccccgcttttttaaatactcggagaagcccatttttccttctgcaaaggtgatggcttctacgggcttcatcgtgcggaggcttgcaaaaaacggtacgattttcttgattttgtccagctggaatggcttcagatcaggcaatttggccagcgctttgatcatggtacagtcctctgtgatcgagagcgccttcagcgtattcaaagcggactgttttaaaaacaaggcgggaagcaagtgtttaatcgcctcggtgtcatcctcattttggctggcgtacaagtaggcgagaatctggcggacgatccgtctgctataaaacgattggacgccgcggtcagctgtatacggaattgacgattgatgaagcctttcatatatagcacggcctccgctgtttgtgcggtaaagaaccgcaaagtcttctggactggctccattttgaattttttctttgatatcggaaacgaccattgtggcttcttcctcttcatcataaggataaaacagcacagggacctgaatgtcatcgcgggcagcttcaagcgttttggcatatctgtttttgttctttttcacaacgatatcagcactagagacgatcgggtgcgtagacctgtagttcgcagttaaatagatcgtcttcgctcccggataatccttttgaaaatcaagaatgaaagacggattgcttccgcgaaacgcgtagatggactggtcatcgtctccgacacagcacaggttttgctccgggctggcgagcatttgcatgattttgtattgaaccggattaatgtcctgaaactcatcaattaagatatacgtaaaccgagattgatattgttccagaaggtcaggccgctcgataaacaattcatagcaggctgaagccatgtcatcaaaatcaaattggctgtgttcttttttctggcgttcataatgttcatataaacgataaacttgtttttcccactcatcttttagagggatgcgttcatttgggacataagtgtttttccaaaaaccgatctgttgcagagcttggtcaactgggaattctttctcatcgatgccttcttcatagagtgcttttttgatatattgttcccgctgccactccattttcagcagatgctcaccgttccatttagcagaattagagtgatacaagatcttataaaacagactgtggaatgttcctgtcacaattcttctgacttttgccggctgtaatccgtactggttcgccatacgctctttcatttcagcgacagcttttgttgtaaaggtgacaagcagcatattttcaggcggtatgcctaagtgttcgatcatgtgggcggcacgggctgtcagcacccgtgtttttccgctccccgcacctgcaagcacgaggagcgggccctctgtttccgtgacagctttcagctgatccgtgtttaaaccgacagacggaaaaaggctcgtatcgggttctattgtttttggcacaaatggtgttcctggtttaatgcttctaggacggtgccattctgtaacagctggggacgggtcagcggcgatcgcttttcccttgggtaaacgaatcacaccagattcctgatcatcttcttttttcccctctttagagggcttcggttcgcacgcctcctcacatgccggaaaatcgcctggctggcgatggataaactctggcggatcggcgatgttaagccgtaacaaaacgggctttccgcaatgagaacaaaataaatgtccttttattccctcttcaaagaggaattgataatgttctctcgaatatgtatgtaaatgtatgattctatcattcagtcgggcgcatttcaaaaaggggtcctcccaatcaaaaggtgttcattacagacaatgactatcatatcaaaagaaatgtgtttcaaaaagtaagtttaagggaaaagagacagcagaggggtgggtattgtatgatatatgcaggtcaaattcagaaccagcaatacgctcaatatgctaatagaacgattggacataagcaggattatgccggaaccgaaaaaatcagctatgtcccgtttcagcgggtatacaaagaactggaaaagcagcaggagaatcaaacggcagctgaaagaaaagtaaacgagatgaaacgtaagcgctctctttataagagattgcgagaaaaaggaatgggcacatatattaatcgatatgtataaaaaaccgttcataccagagaacggtttttttatatgcagtaaaaatccggatctcaaaagatccggatgcgttcagtccttcatcatttgtaagtgcggaatgccggcatcgaggaattctttttcagaaagcacgcgatacccgtgtttcttgtaaaacggcacagcctgtgtttgcgcgtttaaaatgaaaccggaagcgcctccgtctgccgcggctttttcgagcgctttcataatgatgccgccgacaccggctgagcggtggcttttcagtacgcaaatccgctctaacttgccgtagccgtccttcatgcgccatcttccggcaccgactggcttttcaccgtcatacacgacgatatgctctgactcattttcaagttcgtcaatttcttcttcagcaggcacgttttgttctttgacaaagacttcttctcttacatagaatgcatctttcagttgttcttcattttttgcgataactgctttcaaacattattctcctctgcctagcaagaaggtttcatatactgtccacgatccgttttccaactggtagagcaagtggaaacggtcaacgatttcttcatgcgacacttcctgcatttttaattgtcccagcacatctgaatgctcatcgtcggaaagattttggccgaccgtcacatgcggaacgaaattatattcctgttctcctgccaacacaccggtgtatagcttttcattgagtgttattaactcttccgtcggttctgctttgatgtaaatgacattattgacaggcgcaaatgagctgtattttgtcattttgagaacgagtgggtgggactcttttgcgatgtttcttaaatgtgatacgagctgatccgctttctcctccgcgcattcaaaggatgctctcagcgtcaaatgaggcgggattagagagtagcttgggtcatagcgctttctgtaagagtttgcaaggtcttggagcttttttgatggaaataaaacgattccgtatttcatattatgtccctcctggaaataaagtatgatagagtgttaaagcatttttttcagcgccggggtgatgagcggctgccagtatgtccatttgtggtctccgtcaaatggctcgaaatcataatcggaaagctttttctccagcagctgtttcagctcccggttcggttctgtaaagtccagaatgttcccgtctgtcgtgtggacgtcagtttcttttgttccgatttggtgataaatagagaggtgttggatatcgcctgactgtttcacggcttctagtacgtgtttgtcaacatagggagactgcatgatgatgttgccaaacatattcggataatcaagcgctgtcataagtgacacggttgctccgagcgaatcaccgatcagcgttcggccgtaaccgatctgataggttggatactcatcatctgcaaaaggaacgagctcatgggcgatgaaccgtttataagccgaaaattttgaaccctccggatgataagtgtttctgcgctcttttacatccttatagggaacaccgataataatgctccggtctatttcgcgtttcgacagcaattcctcaacctgtctgccgattctccccagcctgaaataatcgtggccgtcctgcgcgataatgacatggtatttataaagcggggagtagttggacggcagataaacaagcaaggtcatttcctcgttaagctcttttgaaaagaatttcttttcttgcactgtgccgtttttcggtgccataaaaacattcctccaggacatcactatactttcttgcattttcaattattgtaccatgaattattagaaatttctctctttaaacggttcggcacacgaagaaaaaagtgttgaaataaactgtgaattgcgctaatataaaacaatcagaaaattgaaatcgatatttcttatcgtgagaggtggagggactggcccttagaaacctcagcaaccggcttgttttgcatgtgcaaagcgccaaggtgctaaatccagcaagcgttttttatgcttggaagataagaagaagcgttaaaccccttcttcttatgaagaaggggtttttattttgaaaagggaaggtgtcagctatatgtcacagcacgttgaaacgaaattagctcaaattgggaaccgtagcgatgaagtcacgggaacagtgagtgctcctatctatttatcaacagcataccgccacagagggatcggagaatctaccggatttgattatgtccgcacaaaaaatccgacacgccagcttgttgaggacgcgatcgctaacttagaaaacggcgcgagagggcttgcctttagttcgggaatggctgctatccaaacgattatggcgctgtttaaaagcggagatgaactgatcgtttcatcggacctatatggcggcacgtaccgtttatttgaaaatgaatggaaaaaatacggcttgacttttcattatgatgatttcagcgatgaggactgtttacgctctaagattacgccgaatacaaaagcggtgtttgtggaaacgccgacaaaccccctcatgcaggaggcggacattgaacatattgcccggattacaaaggagcacggtcttctgctgattgtagataatacattttatacaccggtcttgcagcggccgcttgagctgggagctgacattgtcattcacagcgcaaccaagtatttaggcgggcataacgatctgcttgctggacttgtcgtggtgaaggatgagcggctcggagaggaaatgtttcagcatcaaaatgcaatcggcgccgtcctgccgccatttgattcgtggcttctgatgagaggaatgaagacgctgagcctcagaatgcgccagcatcaggcaaacgcgcaggagcttgcggcgtttttagaagagcaggaagaaattccggatgtgctgtatcccggaaaaggcggcatgctgtccttccgtctgcaaaaagaagaatgggtcaatccgtttttaaaagcactgaagaccatttgttttgcagaaagcctcggcggggtggaaagctttattacataccctgcgacccagacgcacatggatattcctgaagagatccgcatcgtaaacggggtgtgcaatcggttgctgcgcttttctgtcggtattgaacatgcggaagatttaaaagaggatctaaaacaggcattatgtcaggtcaaagagggagctgtttcatttgagtaaacacaattggacgctggaaacccagctcgtgcacaatccatttaaaacagacggcggaaccggggcggtcagtgtaccgattcagcacgcctcgacttttcaccaatcttcatttgaagagttcggggcatatgattacagccgctctggcacgccgacaagaacagctctcgaagaaacaattgccgcactggaaggcggaacaagaggatttgctttcagttcaggcatggctgccatctcaacagcatttttactgctgtcacagggtgatcacgttcttgtgacagaagatgtatacggcggaaccttccgtatggtgacagaggtgctgacccggtttggcattgagcatacgtttgtcgacatgacggatcgtaatgaagtggcgcggagcatcaagccgaacacaaaggtcatttatatggagacgccatcaaatccgacacttgggattacggatattaaagcagttgttcagcttgcaaaagaaaacggctgcctgacctttctggacaatacattcatgacaccggcactgcagcgtccgcttgatctcggcgtggatattgtacttcacagcgcgacaaaattcttaagcggacacagcgatgtgctctcaggtttggctgctgtcaaagatgaagagcttgggaagcagctgtataagctgcaaaacgcgttcggcgccgtccttggcgtgcaagattgctggcttgtcctgcgcggattaaaaacattgcaggtccgtttagagaaagcgagtcaaacagctcagcggcttgcggaatttttccagaagcacccagcggtcaagcgcgtgtattatccgggactggctgatcatcccggcgctgaaacccataaaagccagtcaacgggagcgggcgccgtgctatcttttgagcttgaaagcaaagaggccgttaagaagttagtcgagaatgtgtcactgccggtcttcgctgtcagccttggcgccgtggaatcgattttgtcctatccggcaacgatgtctcacgcggcaatgcctaaggaagagcgtgaaaaacgcggtatcactgatggcctgctccgtctgagtgtgggcgtcgaacatgcagacgatttagaacacgatttcgaacaagcgctgaaagaaattgctccagttgcggttcgttaaaaaagaagccggggatggcccggcttcttttattattgttcgtcatcaggattcagaatcgcgaggacttgatgatcctcccaaacgccattaatttttacattttttcgggcaatgccttctttatgaaatcccgctttttctaaaacacgcatggacccgagattacggggcatcacaccggcttcaatccgatgcagtttcaattcgtggaacgcataatcaacaaccaatctgactgcctctgtcataatgccctttccattatgggctttgtctaaaaaatacccgatgaacgcagtttgcagcgcgccacggatgatttgaaagagcgaaaccgtcccgattaatctatcgtctgacgctgtaaagatgccaaaatgatattcttcatctttctcaagtctttcctgatactcggttatccgttttctttgcccctcaaccgtatagtaatcgtctgcgcgtatcatagaaaactgttcgaaaaaatcccgattttcgctttgcagccgcagattttcttcggcatccgttacttctaaaggtctaacataaatggtttttccttttaacatacagtgatctctccgttctcgtgtcagcattcctcttacattattctcagggaaatgcaaatatcctttttataagaaggaagaaaaccaatttcccataaaagtgccaacatagttgccgattaagtagccgagcgtaccgacaagcatgatcggggcgacaagctcccgccatcccttggcaattgccatcgcagccgcagtcgtcggtcccccgacagtagcgttgacggcgagcagaatttcttcaagccgcacgcggaacaattttccggcagctaaggaaaccgctaaattgctgatcgcaatgataaacacgaataatagaataagggggcattcgtgacgattaaacggagatctgcaggaatgccgatcaccacaaaaaacaaataaatcaaaaaggttccaagttcctgagatccattgagcctttcaaaaaaacgcgggaaagaaaaatgataagaacagttaaagacgtaagcaccaggtactgatcgccaagcgtaccggtcagcaggggatgagaaaaaatgcttttaaaataaccggaaaccttcatactaaccgcaacaagcgcgaaagcggcaccggcattaaaagcgatatcctttaaggaaatatccttccgtttccaatagctttcagcactgtttccgctgtttccatcggcttttaccttctcttcaaacggcatggcataatgccgctgaaaccatttgagtgcaggaatgctgattaaaataaaaaacaaaagcgccatcataaaattatcagccacaacggtagccgacacatattcaccaggcgtctcaaattttgccgccatcgccgcaaagttgaccccgccgccgatataagaggcgctgatcatcccaccgattttatctaaataaggaatatgctgtttgagtagaaaaaaagccaggatactgccaagcactgttccaacggagctaatcagaaaaataaacagcaaacgcctgctttccttaaaaatttgcctaacattgatctgaaacaataaaagtggtatcgccagcggtaccacataagaccacacagtgtcatacacgggcgactcaacaggaagcactcctacatttgtaaacaccatagcacctgcaagggcgataatagcgcccgacacagcagacgcccacttaaagcgctgctccagcccgatgctcactgccgcccacaccgcaataaacccccataatacccatacatcatcagaagaaatcaaagaatgcaaaacccatcacctctattgttagaaaattaagacatattataatagccggggaacggaacagcaagtccaaaaaaagtttttctaaaaaagcagttgacgaatagaaggtaaggttatataatagaacttgtcagaaaggcaacaacatacccagcaacacatacatatcatgattccgtagctcagctgggagagcgctaccttgacagggtagaggtcgctggttcgagcccagtcggaatcatagcttaaacccttgcgtagcaagggttttttattttgctttaataaagccggttcatcatattcgcgagttgttggcgaagtgaaaaaaaggtcccttgaatttccaaggggcctaaaggattaaaagcctcaatcaacgctcttatacctttccgggatcttgtctttccaaacaagcataaggtttttaagtttttctgtttccatggaacttttgtcgttttcactttctgtatataggtgttctacgactgttatatctttttttatatatgcaatggtggtgtttaattgaatctcataatcttcggacgtgccatccaatacttcttgaataatttttaagtattcatcagcttcatccaacgaaacaatgtcttcaatgaaatcagaaaagtattctagttctgtgggaagaactattcttaagtatcctaaagggtctcttttaaattcaaatgaattttccatgatcaatcattcctttggttttttatataaaggatatgcagttgctattgagccatctttattaatgtacatctctacatcaatccctgatgaagttttaccgacatacttattatcccttattagttttttgttttggtaagcttcggaaattgtattgtaaacttttactctatcccattcttttggaaagaaagttgaccttgctactttttttactccttttacttctactttagctctatatactccgtttacatcaggtacttcttctgttccaggtagtattctactaccactcatcatactttcatgatggtaacccacagctttatcttttctgttaatttctccatggtatacgtgctttatcgttttcttattaataccatttgacttgacagatttcctcagaacactctctttattatcttccgcaatactttttagcagcggagtatttttcacattaatcgtattctcagcatcttgaaggattccttctaatgcaggagtataccgattgacaggagatttgacaaactgttttacagactttccgcctttcttaattgtgccactagctgctttcccaactttagcaagatccttcgagcctgttgagacagaggactttccacctttcaacaacagaagacttccgcccaaataagtaacatagtgcagccgtgtgtatgcatccccatgaatcatttttgtatcccaattatccttcaatgtgtcaaccatactttgaaaggcagcttgatagtcgtattccaaaacggtatccagcactttttgaggatccttgttcaagttatcaatcgtccaaccgatattccatccgaattgaatggctccttcaccggtatccttggcaagatcgtatataccaacaatcgcacctttggcgccatcacctatgatttgcaacacttcttttccgttatccatgaaagctttacgctgttcaagaaatgaaacaaattcaagctgttcaggggtaagattctcatatccgaccttcttggcaatgtctaagtattcatccggatccgtcacgctatcagctagcttcttcttcaattctttgatttctcgttcttttgcttcatctttcttgatcttcaaataagcttcagtttgtttctcaaaatcgccttttttcttatgtatgtcactttctctatacgctttggcattgtagtggatgggtgtagcattcttacccttgccagtggattcctcaagcttttgaaagtccttcttgatgaattgctcgtttggctctgattgggcatattcagtaacaagtgcttcgtccacgctgcctagtttatcgactgtttttttgcgtttgtcctccgcgtcggcgagttcgtctttaaagtcctcagttgaaaacagatcaagcggaaggatatcgtcgatatcatgtaagatatctttcatggctttcttttgttcagatataatagattttgattttgtgtaggcgttagccagctcgtgttctaagaaggattcttctatataagcatcagataagctggcgtcctctagagtgcctgaaatgcttgtcaagaaagcaattttcatatcaagtaagtcaatccaattgtcagctacacctgcatggtcttgataaaatgctttaatgttgtcagcacctttgccggaaaactcactgtcatctaaatcagctacagctttaaaagccttttttagattgaccatctgacttcttaattctttgtattcctttgcacgtctatctgcttctgaaagcagtgatttggcttcaaatactttcatgatcatatcctttcattggaattcctaaccaagatattaccatggaagaaagaagaaaaagacaaataagtatttggaaagaggaaaatgataatttgatctgagtctttgttcctatcttgtgtttttaagcaattgagatgagaggttgaaagtgataggcgaaagctactcggaatcattcgtcagcgtataagccctcttgtgacttcaggaaagctcaagccggttaaaaaggttggaacagttgcattgtttttgcttgaacatgtacaagccctgaaaaaagaattagaagccggccggaagaagtaccggccgtatgatgaataactaatgtactatttttttctgaagatttaatttcacttacaatctttttgaattaaaaaattgtgctagttgacctaatgggtcaacttttttggctctttcttttgattcttcatgtttttgtttggataatctaagtctagctctctcggtgtctacaagtttacgaactcttatccgttcattgggattttctatgtattcctctgtaattgcgtaccaatccttgatgtgtaaatcggggaattcattatttcctctattgcctgttctaaatgttccatcattagttttcataaatggtatattaaattcatctgcatatagcgcggaaacaaattctcctttatccttttccaacttatctaaaccatactcaaaacccaatgcatataaagagttttccatcatttcctgaatttcagtttcaatatgtttttcgtgttcaataacaaaaaatactccctgatttttataaatctcaaagtcagtggctatgcgactgaacttcttatttgatttaaatttcattatttcattctcaacaacatctgcaaataacagaaaagaatgtttttctgttatataatttaccgcatcaccaagacaaagattaatccagatattagtatcacatattgggtacttagagaaatcaggaatcatgtttatccctcaaactttccaaaaagtccaaaatctgttggactttttcttctgatactcgcccatcttgataattttcttctaaacgcttatagaactttggtgttatatataattcattggtgggttttatcagagaggtatcgccattatactctattgtgagctttaggagcttttctttattttcaatcgatcccagttcttttttttcgtttaatgagtttatacagtcagggaaaagtagttttaattttgttattagagcgccgtaactcacacgaaagtagttttgcattgttattaattcataataagttatatgatctacattggtgatattttgactttcaaggtattcataaattaattctttcggtaaaagtatgttacttgcaaaacagtctgctttaaattcatcttcgtctttgaaaccctcaccagataaacttattccactttcttcgcctgaaatagcatgataatattcgtgccatgcagaaaagtattgtctacctaatgaatgtgcactattgataaagataaaatcataattgctttttttgatgtgaaatccagataaatcatcatgggcagggaatttcacaataaaaaagcccaaattctctaatataccaaaggtgtctttaattggttcattctcatgaacaagacttcttcgatatttagaagcaaattgggcagattcctttgaaagaatatttttgcgttctatagtcaactcactcaaaaaaagacaccacctatcttgctcctattttctcttgcatgacaatttcattaaagataatatttgcaagatgaacggactcgtctatatcattactcttcaatttagaacgataactaatacctgaaaggttgtctttatctttttgaagcaattctcttctatcaacacctaaaaattcactaataacattgtaaatttttgaattgaaaactcttgatgcctcttcaatgctattccaaaatttagattctacaccgaatcttttcgctacgctttccacagaaagacctttttctactcggtaatcctttaccattttggctagctcataacgagtgtattttggtctttcataagggttaactttgattttgtcaaaaatcgtccccataaataactcccccatttaaatctcaatttgtttcttaagtatataaaaaacagcaaatgttgtaaataaaattaaccggagaatttcgtccattctgtatgcttttatatatcaacagaaataatcgaatcaaatccaataaagttagtatctccttttagatccttcacatgaagccttttttaaaatccatttatgtaatgtacttttcccgtgatcttctcaataaaaccatccctaaaaactttaatgactacagtggagttaaattccatcgcctcgcaaataacacgtgcaccttcctccagttggtactcatcaagaatgggtttttcgattttctgaacttctctcttcctatttaacagtgaagccctttgctcaggcaatatgaatttttgttcccatctcttgtcgtaaattccttgactcattccgatcatctccttgaataaattatatgcgaacaaacgttcttttatcaacggagaaaatattggtaagtctgtgaatttacccattggttttaaatgggaaattgttggcgagttgttgcccaaacctgccaacaattaatatttttattcagaagggatcagacatctattttgaaatcccttgatggataagtatttgtcaggaataaaaataacagctcagaaggtaatcactaccttgacagggtagaggtcgctggttcgagcccagtcggaatcatagcttaaacccttgcgtagcaagggttttttacctttcacaaacttctgtcggaacctgaatagtgcaactggtcacctagttgtgaagtttttttagaccaaaaagcatatcacccaatttctgtaaatttcctttcatttagaatgtggctataacgatcaagagctattcttgtatttgcatgtccaagttgttttgaaacataactccttgcttttaaataaaagtgtagcgtgggtgtgtcgaagactccttggattaatctgtgtgctgaatttattcgtgtttactggattcaaatccgtttaaagcagcctagttgaatatatgttttttgttcaagtttatcacgctttaattcagttacaagttcatttggaatagctatggtaccatcccaaatgttgtttttgttaagagttttagaattttctccctttgcttaagttacatatatgattccttcatctaattcctgcatctaattccatttctcctagaaaaggccgaaaatttcgctttgtctcatactgtgtttattgcaatcaaatacaacatgtataaatgactatcttttgctacctctaagaatgtttgaacttcatctatatcccatgccaccaattctgcctgagtctcttttggaggattaactagcttcgccatatttttaatagttaaaccaaactttactgctagttccaaatcattccccaacatagtatggatcttcctaacagtatattggttaactttaatattttaaaccaggttaaactatctaatataacatacagcatacaagattacaaagattaaaaatccgaagtgagacctgcttgatacgcttttcttcaatcatgatattgtaattcgtggcatccctgaaaaagcgtatggatatgtgattaatgcttgcccttgcaattgaatggattattgatcagtatcaagtgaagacggataaaaagtcaggtattgttgatgatcccaacctatactttgatgatgaacgttactatgtataataaactttctgtttaaacggtagatttggttaacagcttaaaattgcagatgtaaatttgaaataaggatacaatatccgatatagagacctgttgaagaaaagatacatatttttttgtgagacattatccagcgttatttgaaaaaatcccagttgttttatagtgtgtttggtaattatttgaaattggtgacgtgaaattgattcttccaaccacatcacctaactgaattatgttactatgtaaatattagaaatagttgattagaaaaacatgaataaagattttaggttcgattgaaaaaggcagcactttatgattgaatggaaaataatatcacataactagattgcactaacatcagaatatattaactatgttgatacagagcaatgtttgtaaagggggaataagtggtaggaacagtttgagtcacacttttgcgatgaatctgctggcaacccagattactctaataatatgagttgatatgggaataaattacagttagaagagattcattatctcgagttgctaaatattttgggatcagttttgacggtgttcctgggtgagtggggaaacaaaatcgaaaaattaatagcagaacatccatttttcgattctggaccaagagacgaagctaaagaggcagaaattattgaagatttggttggtaaagctacagtaatgatccaagataaaggattcatagcagaagcaagagctagttgaggggatctacgtgctatggaatatagtgtcaagtaagtccaaaaggccagatgaagcgtataaagaatttgaaaagcccattataaagacattgaaaatcttcagctggtaccccggaattcaacagtttattgatgctagtagtttatttgtacaggggattttcttcgttcgcatacagaagcggtagctaaacttaactctgttagaatgatagactaagatgaactagttgacttaggttgttaaatggtatgaacatattcctagtgatgtaaggacttttcttctattttaaagaagatttttatgtactgggtgacacttattatttcattgaatataaagataatttatatttaattataaactaaacacaaaagtaaaaattattttgggggatacaatgcctagtatagaattaaaagattttgttaatgatactgaatttataaataaaatgaatcaagcttttgctgatttaagagctgattatgaattaagtttagatgttacaaaggagaaaatagacgagcttaccaaagttcatgttgataacaaaaattatttaagtaatttaactgcgttatctgtaaagtcaagtggtgtaatatctgggctaagaggaacagggaaaacacatctattcttattagctagaaataatataaataataatatcgataaaaataagacaatttgtatataccttaatgtaaaacgtcttcacttaccatcgaattgtaatcaagaggtattcaatagagtatttagtgtgtttatatatgatgaaatttctaagcaactaatgcaattattaaaagatattaaagatgatatgaatttcttagacaaactgttatcaatttttaaagatgataaacactctctaattgaaaatataggagaagcgattaaaaaaattacgatttttaaaacaatagcaacacaaggaagtgattatttagaaaatttcggtgaaggtgagtttgctaaagaagaacttcataaatctctaatagaatttcaaactgaaattgcatctaaaattggtattaagggcaatgatatttctacaaaacttagtgctaaattattagaagagttaaatcaaaaagttgtttcgaataataaatatttaaaatatttaaatattaatagtgtaagggacagcatacttgatatattaaagattcttaatttaaatagtataaccttttttattgatgaatgggaaaaactatataaaagtgagaatgcacaagagtttttatcattctatatagataaaataattgataatcctatttacttttggattggaatagtaccatatagaggtcatttatattatttagacaatggcgctgacctacagcactttctaaatttggatgagagtttagtgtatgaaagttccaaacaagatcgagatttatgtattggatattttaaggaatttattaataaaagattagcgtattattttacagaagaggattttaattatagcttactatttaatgttgacaagaaattagaattactggttttagctagtatgggtaactcaagagactttggaacaatgctacttaattgttggtcatcatatcaagcatatagatccaatagcctttcaccaggtaggccatttaaatatattaatcaaaacatgataatcaattctataaaaaataacggagacaagaagtttagtaatattaaaggtaaaagtaatttattggcactatggagagatattgagtcattttgtttatcaaaaaaatatagtcattttgcaattgaagatacaaaagaaaatatggaagccatctcaactacagagttttcggaattaacctatcataggttgcttcattttagaaagggacatgttcctcccaaagatactaagatagaaaataaactatccatatatgccttaaactatgcaggtatatatgacttaatagcaaaagacagaaaaattaattttgttactgaatatgatacgatacatgatagagtgagaagatatatttatgatcctaaagaaattgttaataaaataaagatcataagtggtgagatatttccatgtgtttcttgtaaaaacgatattaatattaaagtaatggtagctgcatgggaaaaaaattcttgtccattttgtggtggtaggataagaaatcaagattagattaaatgtgttttattaattaaagaagttatagagaaaaggagaaggttcggttaaagcttctccttttaatatctaattaccgtttcaaacttgaaagcgttttttgtttgtcttattttatggggctatccttgctctttagagattagcttacttacacagacggggtttgataataagatacagcttctattattgttaacacgattaatatggctaggatgcttccacagtgttatatttacgccttttatcatgttatacccctcacttttattaagtgccaactggtctctctgctatttgcatatcagttccggctggtctttcactaaaatggaagtctgactgagcaaacaaaccagcgccagcagctaacccacttaagataatagctgtaacagacacacgaagtattgatcttttcatccaaatgctgattgtcaacaaaaacaaagtttctgttttatcaattgtgactatcgttcttatccttgcctcaattttttggacgacatttattattatcgcatggcaatctggcttgtgattagagattgctaaggagatatatatccttagaattttttattaagattactcgtttcactccattgtctttcttcttattctgaatttgatttcttttcaagaattattttttttgtccgtaaatcccatctatctgttgttctttagtcctttgtccagatagttataaagagttgccaggaggttgaggactccatacacaacgaagtccttagcactactgaagttgctgagatatggaacgtaaacaagcagcccaggagcacattgattaatacagaacgaatagtaccagttaaaatgatcggaaggacaagtttatttttgagacaggatgtagaggacttgaaaaaggaacttgaagctaatcacaaatatcatccaaacaaataatccctcactacaatgtgaaggggggttttttaatactcgcatggtttattttcacattctggcttttctttagcatccacataagacgatgttatagtgtcatttgacttgtcataaatcccccaaaactcttttcctttgttaccgttcaaatacccctctgcattaatatcgcccattgctaattgtattttcttcattttctgagagcacttcaattatttcatcccaacttttttgaattccatagtcatcattaagattaagtttctttcatttaattaatatagttttcattttttctctaaattaatattgatcctcttaactaagcagggctattattttcctattgcctttcctattgttacatctccatcatggaaaaattcaataacataaccagattcgctgaacatgaaagtatcggaacctacagcagttacatcatcaattacgtttaattgagtcagaattgaaggtgctgggaggaaagacaacatctaaactgttatcatctgcgtctaaagcttctggggcatttacacagtcaaaaaaagtgatactcttccgttttttaataaaaagggagtttaattaataaataaaaaaattcgatataattaatgaaatatctacagaagattgttaccacaaatgcaaagcaagaaacgaaagtgcccatacaaatatgccgaacattacaaagaatctaagaaaagtttcatattttgtaagtttccgttctttttttattttacctaatttccagtaaagggcgtagccggagaacaataaaattatttgtcccagttgcgacacggactctaaaaattctataccattcattgatttcacctcttatttaattatcgcaggctgaaaaactgtttccaacagttatataaaaattaagcaatccgtaatatgtctaatggtataagaaatgatgtttcccttatcctgttattattttaacgaagaagaacttttttactaaatcttgataaagcggaaggatatttctatagagaagtttattcacgttataagttgaatccattgtaggttttgtaggttttaaggactggcattgttttaaattcagccctcgttgagtcatttgtgaggtctactgcgataaaagcaaattaccacgcaaaaagagcccatcttatataaggcgggctttataccaatagaaaaaatgttgttatgcctatttacaatgatcacaatatttataaatcactttcaccagccagtaaacctataagactcaaaacaattgttatagcaaggaaagcccagactaacgcagcatatggagtgttaattcctgtgctttctttccacttggaaaatcgacttgttctgaattttcctagctgaatacataaaattacgtttaataatactgatatgacaagggctgttactaaatataagttcaaacccatcaacctttcttttataggctttatcctagtgtaatctataagcagatgtagatttcaagtgtcattattcatgtttttttcagaggctacatatgattgtggagttggtgcaaagagtatgataaaaggagtagcatgaaaaagtttgcggttttttgcggacatacatattttggggaatgttagaatgttacataaagggtaggggctgtcggtttattaatgcagtatatgatttaaatgaaaactcaggataatattgagttgagaagataaaataaaaaccccatttctaaattctaaaatggggttatttcaaatatcatattaagttgctgctctatctgcgaccttataagtggactgctcagaaagagcgtatgaagcgctagatactccaacaacgccaagcaagagcgctaaacaaattgcaattttacattttttcatttaaatgcttccccctttgaatttgtttgcgtgcttcaattgccatttgataaaaatcgaccgcatcatgtctgtcttctttgttggtcaaaaaatcagcaacagcaacagcgtattcttccatatcaccgtaaaggtttttctcttcgaagaacttgaacacttctctaagtgtttgtaagtcgaatgataaataaaggcctttaaccagttttaatttctcagttacttcctggttgttgtgtcgggcagcaaccttctgaccttcctggtataattctaatgcagcctttaaatcatttttctttgctttgacatatgccagattaaaaatcgctttggactcataaatgtgttttcgatccttatgaatttcataggcgatttgaaaatgtttctcagcattgtcaagttcttcaaggttattataacataatcccacgttaaaatgagctgaaccaattaaatgttgctcccctatttttatagcatcatttaaggctttttcagctgtttctaaagcatcctcataacacattttatctagccagttcccaaagataacaaactgacattggaccatttccttgccatatgtaaggttcccctgagcatctttttgctctttaaatatagagtatgctcgctgggcataattcattgaaaaatgagtctctttcatatagtaatagacttctgacattttgaaatagaactctgccttatctgtatttgcgttcttatctaataaatcaagatatttttcggcttcgcgataatatgttaaagcaataactaaatctctcgttctaaaatgatacatgccggtaaaaaaatgataatagaactctattgtattggtgagggattcaggagccatattttcccttgtctttttgagatcagcataaacaccatctatatttttaacagagtcaggttcgagatacgaaagcattatttcgtgccgcagctttaatagctggagatagactgctactttttcatttttctccatcatatcgaattctttttcaactttttgtttcatttcttttgctttctcaactcgaccctgttttatgacaacataccaatgattaatgtctgtagttacgtaatgatatgggattaaatccgaaacagacaatcaaatacctccttttatttacatatatttaatattataccactaaggacaccctctaaaagaattattttttgaaaagtccatctatttagactgaaaaaaggtcagaataaacataaataaggactgtatcgtctgatatgaactctttagcttgctttagaatttaagaaagctgatctaaaaggcactcgaagtcgtctaatgatttataaatggcatctatctttttcaagaaaatgttataatgaaaagccataaaatgataggagggggaatttcgatgcattacataacggcatgtttaaaaatcatcagtgataaagaccttaatgagataatgaagaaattcaaaaaacttgaggaagaaacgaacaaagaagagggttgtattacattccatgcttatccgcttgagccatcagaacgtaaaataatgctttgggagatttgggaaaacgaagaagctgtgaaaacccatttcacgaaaaaacacacaatagacgttcaaaaacaagaattaacggaagtagaatggttaatgaaaagcaatgtgaatgattaaaaaggcgtcttcaaaagagacattcaaaaactaagaagcggaaagttgttggcggattgttgtccaactccgacaacaatatcatgcggagaattaaatacatttattaataataagtttaaaagcttggagaaaaaaatgaaaaagaaaacccaaattatactttcccttttagcagcacttatagttatattgatagcactaccagttctatctcctgttgtttttacagctgcttctgaaaaaggagcaatcagacacgaaatttataaaagaggatatccctatcagagctactttgcagttctccaaaaagaaggtgacaatgaatctgggaatctttatgatgtgaattggcttgattggaaaggtgaaacgggacaaacgcctcacttatgctattcaaaaaaagcatcaaacggtaaatacaaagtagactgtggaaccgggccgtaaaaaaaatgcccgagatgaaaggtctgcggatactgatcactggacagagaacgctgtgctttggttggtgtccgttttttatttcgtatactaagctgacataaaacgaaaacaagaagctatcacagaatcaggtcgtttctagcagttaactcaaaatcataaaatcgcatttttccggaagcttcggtaaaaaacgaaacttttgtctctatgattttattttataatgtaaacggtttcttatatagtatacttatactatcaatttgctcaagtagatactgacaggaaggatagaaaaacagatggaatacataaatacaagacaaaaagagattttgtatctgttgttatctgaacctgatgactatttagttgtgcaagatttcgcagatagggtacagtgttctgaaaaaacaatccgaaatgatttgaaagtgatcgaggattatctcaatgagcattctcatgcacagcttattcgaaaaccagggttgggcgtttatttacatatagaagaacaagaaaggacctggctaagccaacaattacatactgaacatttttcttctaggcagcggagcgatgaagaaagaatgctgcacattgcttatgacttattaatgaatccgaagcctgtttccgcaaaagacattgctgctcggcattttgtcaatcgatcttccataaaaaaggatttatacgcagtagaagagtggctgaagcgttttgatctcacgctggtttctaggcagcggcttggattaaaggttgaagggaacgaaagaaataaaagaaaggcattggcaagaatatctgatttgatccacaatacagcgtttaccagccaatttattaaaagtaagtttttacattatgaagtagactttgtgacgaaagaaatcaaatcactacaaaaaaagcattccctctatttcacagacgaaacgtttgaaagtttgctgctgcatacattgttaatggtccgccgcatcaaaatgaagcagccgatttcattgtccccaaaagaaatggcggcagtaaaaaagaagaaagaatatcaatggacatttgcttgtttacagcggcttgaaccggtttttgcaatccgcttcccagaagaagaagccgtgtacttaacattacatatattgggcggtaaagttcgttatccattgcagacagaagagaaccttgaaaatgctgtgcttcctaaggttgtagggcatttaatcaatcgtgtttcagagctgaaaatgatggattttcataaggatcaggatttgatcaatggtttgaacattcatctcaatactgtgctacaacggctgagctacgatctttctgtagcaaatcctatgctcaatgacatcaaaaagatgtacccttatttgttccacctcatcattgatgttttggaagacatcaatcaaacttttgatcttcaaattcctgaggaagaggcagcatatttgacattgcattttcaggcagcgatcgaacggatgcagtgcagcagcgagacacataaaaaggcgattatcgtctgccacatggggattgggatgtcacaattgctgcggacaaaaattgaacggaaatatcaccaaatcgctgtaatggcttgtattgcaaaggccgatttaaaggattatatcaaaaagcatgaggatattgatcttgtcatatccaccattgcgctggagaatattacggttccccatattgttgtatctccgcttttagagcctggcgaagagaagaaattaagtgcgtttatacgtcagttgggcgaatcacaccgccaaaaacaaaaaacgtttcagatgctgaacaatacgactccttttttggtttttttgcagcaggaggcggagcatcgctacaagttaatcgaacagctggcgacagctttgtttgagaaaggctatgttgataaggactatgcggttcatgcggtgatgagggaaaaaatgtcggcgacaaatattgggtcaggcattgccattcctcatgcaaacgctaaatttattaaacaatcagcaatcgcgattgcgacattaaaggagccgcttgaatggggaaatgaaaaagtttcgctcgtttttatgctggctgtcaaacacgaggatcaaaccatgacaaagcagctgtttagcgagctttcatatcttagcgagcagccggccttcgtccagaagctgacgaaagaagccaatgtcatgacatttttatctcatttggattattaaagcagggattattccttgctttttttttgttatagggaaaaatgcctttattaccggaacctatggtaaaaaaaagcgattttaatgagctgatttcggtatacagttgagacaagatcttattattcacactttaaaggaggtttcctatgaaactgttagcgattacatcttgtccgaatggaatcgcccatacgtatatggcagcggaaaatctgcaaaaagctgctgacagactgggcgttagcatcaaagttgagacccagggagggattggtgttgaaaataagctaaccgaagaggaaattcacgaagcggacgcaatcattattgctgcagaccgctcggtaaacaaagaccggtttataggcaaaaaactgctgtctgtgggggtacaggacggcatccgcaaaccggaagaattgattcaaaaagctcttaacggggatataccggtctatcgttccgctttaaaatcggaatccggtaatcatcaggagaaaaaacaaaatccaatttaccgtcatttaatgaacggcgtttcatttatggttcctttcattgttgtcggcggattattgatagcggttgcattaacgcttggaggggagaaaacacctaaaggcttagttattccggatgattccttctggaaaacgattgaacagatcggcagtgcttcattttcatttatgattccgattttagcaggctatatcgcctatagcatcgctgataaaccgggacttgtgccagggatgatcggcggttatattgcggcgactggaagtttttatgacagcgcaagcggcgccggattcctcgggggattattgccgggtttttggctggatacgcggcactttggatcaaaaaattaaaagttccaaaagccatccagccgattatgccgattattattattccggtgtttgcatcactgattgtaggtttagcgtttgtgtttttgatcggcgcgcctgtagctcaaattttcgcctctttaacagtttggctggcggggatgaaagggtcgagctcgatccttctggcattgattttaggggcgatgatctcatttgatatgggcggtcccgtaaataaggtggcgtttctgtttggatcggcaatgattggagaaggaaattatgaaattatgggaccaattgctgtcgccatttgtatcccccgattggccttggcattgcgacgtttttaggaaaaagaaaattcgaggcatctcaaagagaaatggggaaagcggcatttacgatgggtctcttcggcattactgaaggagcgattccatttgcggcgcaggaccctctgcgcgttattccaagtattatggcaggctcaatgacaggttctgtgatagccatgattggcaatgtgggagacagagtggcgcacggcggacctatcgttgcagtgcttggcgcagttgatcatgtcctgatgttttttattgctgtgattgcaggatctcttgtcactgctctgttcgtcaatgtactaaaaaaggatattacggcgtctcctgtgctcagtgaaactgcaccgccctccgcgccaagtgaagctgcggcagcaaatgaaataaagcagccaattcaaagccaaaaagctgagatgtcggaatttaaaaaactgacagacattatcagcccggaattaattgaaccaaatttatcgggggaaacgagggatgacatcatagatgaattgattcagaaattgtcccgaagaggtgcgctgctttcagagagcgggtttaaacaagccattttgaatcgtgaacaacagggaacaacggcgattggcatgaatatcgcgattccgcacggaaagtctgaggcggtcagggagccgagtgttgcctttgggatcaaacgatcaggtgttaattggaatagcctggatggatcagaagctaaattaatctttatgattgctgtaccgaaagagagcgggggaaaccagcatctgaaaatactgcagatgctatctcgaaagctaatggatgacaattatagggagcggctgctctccgtgcaaacaacagaagaagcatacaagctgctagaagaaatcgaataaagcgggggattttcatgacgactgaaccgttatttttcaagcctgttttcaaagaaagaatttggggcgggaccgctttagctgattttggctataccattccgtcacaacgaacaggggagtgctgggcttttgccgcgcatcaaaatggtcaaagcgttgttcaaaacggaatgtataaggggttcacgctcagcgaattatgggaacatcatagacatttattcggacagcttgaaggggaccgtttccctctgcttacaaaaatattagatgctgaccaggacttatctgttcaggtgcatccgaatgatgaatatgccaacatacatgaaaacggtgagcttggaaaaacagaatgctggtacattattgattgccaaaaagatgccgagattatttatggccacaatgcaacaacaaaggaagaactaactaccaagatagagcgtggagaatgggatgagctcttgcgccgtgtaaaggtaaagccgggggattttttctatgtgccaagcggtactgttcatgcgattggaaaaggaattcttgctttggagacgcagcagaactcagacacaacctacagattatatgattatgatcgaaaagatgcagaaggcaagctgcgcgagcttcatctgaaaaagagcatcgaagtgatagaggtcccgtctattccagaacggcatacagttcaccatgaacaaattgaggatttgcttacaacgacattggttgaatgcgtttacttttcggtggggaaatggaacttatcaggatcagcaagcttaaagcagcaaaaaccattccttcttatcagtgtgattgaaggggagggccgtatgatctctggtgggtatgtctatcctttcaaaaaaggagatcatatgttgctgccttacggtcttggagaatttaaactcgaaggatatgcagaatgtatcgtctcccatctgtaacatgcagggcttgagaaataaatttgcgaatgaagacgcctattctccagcaatgatctaaataaaataagagtttaatagttggagaagaaatgttacactcttttctgtatatggtaaagaatgaaaaaacacgattcggttggtagtccggatgcatgattgagaatgtcagtaaccttcccctcctcgggatgtccatcattctttaatatcttttatgaggagggaatcgttatgaaattaacgatttactacgatggtcagttttgggtaggcgttgttgaagttgtgaacaatggaaagctaagagcctttcgtcatctttttggcaaagagccgagggattctgaagtattagagtttgttcataaccaactcctgaatatgttggcccaagctgagcaggaaggagtgagtttacaaggcagacgtcaaaaaaagatcaatccaaaaagattgcagcgccaggtttcaaaagagttgaaaaacgccggagtagcttctaaagctcaagaggcgataaagctagagcttgaagcaagaaagcaaaagaaaaaacaaataatgaaagaacagcgagaacatgtaaaagagcaaaggtatatgctcaaaaagcaaaaagcgaaaaagaagcacagaggtaaataatccaaacaaaagcaggcgcagtgcctgcttttgtaattaattaaggactctactttgtaacatatatccaatgtttataatccgctgatttatgattcaatataaaccctaacttctccaaggttttttgtgagcctagattatcatgttcgcatcttgcggtgatccggtttactgtttcttggtttaatgcccagtttattagtttttgggcggcttccacacaataacctttgcggcgatgacttttatttgttgcaaaaccgatttcaatcatgccattttcgtctgggtcacctaaaaatccagttcccccaacaatttcatgactgtccttctttacaataatccatgaatcaaatccttttgttccattgtttttgactaaaatctcgcggaaataaggtatcgcttcaaaaaaatcagaatttggccattcaccatttgtttcataacctaagtctttgatagcctgatgatcttgtttagacgcggcgtcaagaaggggaatatcaatcgtttttaaacgtaatcgattcgtttcaaggagaaccatatatctaatcctcttttctttttactgggaataatgataacatataacaattttctctgataccttggcagtagagaaagatgaaaaaattgagggggattgaaagagtgacaggtgagagtttgcccagcccaaaaacgggtaggaaaatgctgatgttaatgtgtccctacccgtttttctgttcctgaatgcagggtttctgataacatgttgtgctaccttttcgcaatcaaataaagcgatatggctctttgggtttgcacaggattatgaatgataatgacccattggtttcttcgtcttggaaagcttgctaccgcatacaatggagcagtatcgcgcggagtgaacccaccatttatcacgttgatatctcttccttcaagatgacaaactaagtattcacctggattgatgacctgttggttcgtccatgcgtaagaataaaagccgtctccaagatcttcggtggaagatggggggacaaagccatctacagtcaatgtgatttctcttcttcgctgtctttctgaaaagtctggacttctttgagggttatgagtatgtgaaaagtaaggaattaacgcagggccataaaagtaatgatacaaagcaaccactcctttattttccattcatacaaattgtatgtgggagttatttgttcattcctgttttgttccatgtagtctaataatgggctaaaggcgtccaagaaaatcaatttgtcctttcgttaattcaatgctagtaaccttgaaaatgcaggttaggatgatagaatttacatattactgcaagaagttagacatacatcattttgatagtgggtgaaaacaatggcgaaaaaaatggcaaaaacaaatgcggttcgtctgatagaacagcagaacatctcttatgaggtattagggtataaaacagacggccagccggtagatggcatctctgttgcggaaaaaatcggttatcctttgaaatatgtatataaaacgttggttgcagcagcaggaaaaaatcattattatgtctttgttgtacccgttgcagaagagttagatgtaaaaaaggcagcaaaggtgacaggggaaaagaaaatagaaatgattgcaatgaaggagctgttagcggtaactggctatcttcgcggcggctgctcgccaattggcatgaaaaaattgttcccgacctatattgatgcatctgcagaaacgcttgattttattattatcagtgcagggaaaatcggtatgcagctaaagttggcgccacaagatttagccaaatcatgtgatgccgcatttgcagaaattgtatagatgcagatatagggggaaacaaaaaagcttagtcatatcgattaagctttttccgcatccctttcaaatatgatttcaaaataagcagctgccccatacccatctatactgggagcgaaaatctgaacaaatctccagcctcttttcgcataatcatggatgatttgctggtagtcttctttaggccttcttctcatcgtactcagctcaactcttacgaattcatattctttcatcgtttgatccctcctattaaggtatacgcataattgagcaagaagttccgaaaacataggttaaggtctgcctcactaaatacaggaacatcttgaagagttaatgggctataaaaacgaatttcacagggtcagcagtccaaatgaatctcttgcttattgcatttgactgagtatataagtaaaaaaagagcggccagaacatataagaaagagatgatcattaacgcactcataacagggtagtgtttagcggagtagatgaaaaaatcaagctgtgaaatttgtttggggctgctgacggcatcaattccattaagcagttttgagagtttagcagtatagttccaatcaaatcgatctgaaacaagctcgcttccttgataccaattaacagcagctaaaaatagaaataccataatagaaaatcccagctgaacaactaaaaatattcccttcacttttgtatgacctccaaatctatgaatatgggaaaatcaaacaatatattaccaccgtatgggttattcttgcaatttcacttccatacaactcaaacgcaagtctatttttttgtttgtttttggcttataatacctgatgatggaaaaagagtgcgggtttatagattagagaaacaaatgtatttatttgtggagagagtatagaagcattcgattagatctgctttttcacagaaacggttttcatctgtttgcctgagctttacaattggctggcaaaaaaacaatgatttctttcaatcaaaacatgcaacgatgcgacacattttatatcttgatgacttatctcattgcctttaagtcatcctatcgagaaagcgatggtattttatgaacaaagaaaccctaaaaaacatactcatgattttttcaatatgcgcaaccctccgagaaaccgatggtatgcgcatagctgatagctggattttgagtgagattatacgatttttgatttgcatggttgtgttttttgccatgacatttctattagatgctgtttttccaaacaaaaaagagtcacattaatttgtggctctttttgcatcatctgatcagaaacatcataaatgaatcgatcatcatgatgaagaacagcaagcaaaaataaataagcgagtagacaaacatatcctttgcccacttcacgtcatcgtctattttgaatcccttgatgctttttttgatccatatgcctccgagaaccaaggctgctaaaaaataaaatgggctcatatggccggtgccgagagagaaaggaaataatagcgtgaccggcaccaggacggcaatatattgcatcatttttatttttgttacatgatttcctttgactactggcaagagcggaatgccagcggcacgatattcctctttgcgtcttatcccaatcgcccaaaaatgcggcggctgccacagaaacataatcgtgtacaacagcactgctgtcatactgaagtcaccggttacggcacaataccccatcaatggcggcgcagctcctggaaagctcccggcaaatgtgctccacacagacgttcgtttcacccataccgtatagatgatcgcataaaaaataaaggcggcgagtccgagaaaggccgttaatggattaagggaataaagcatggcaagacctgcgattcctaacacagagccatatgttaagatcatggctggcggcattttccctgtgaccgaggccctgctgcgagtgcgtgccatttttgcgtccatatgccgatcaaaatagttgttatagacagtgccggaagccatcacaaacgcggttcccaacattgctgttaccattgtcatcaaaaaagccatgccggttaacgttttttctgcgcttgcaaacgcgatccaaaacccgccgaaggctgctatcgagtttgatatgataatgccgggttctgcaagtttgataaaatcgtaaatggttacccggtttgaagcttttatgtattttgtttcagatatggctgcagaatctcttgtattctccaaaaatagacgcctccccctaaaactgcatgcttttgttatcgtaacaagagggatacggaatcacaattatttcctatatttgtcatgatattgtcatttttaaaataaaaaaatggggagctggactgcccccattttgatatgcggcgactagtaaccgtaacctccgccatatcctccgccataaccgccgccgtaaccgtaccaagggtagtaaggcgggcgcgggcgcgggtagtaataaggcggacgcggataaaacgggtagaacggataataataaggcggataaaatggccgtctcggacgcggataataataaggctgtctttcatcataaggggtaatttgttcaaatggctgttcattcaaagggtaatccaagaggaaaacctccctagctttttttattccttttaccatattcttgatgcttaagttgggtgtatgtacatttatgaaactcggtttttttatgatgaaattccttaaaaaggattgacatgaacttctaaatctcatagtattacaaatgtgaaataaatgttactacaatgttacaaaagcatttctaaatagatacagttccaactgatgaagagtaaatcgaaatggctacgaaagaaggagtttttgttgttggcaaaaagaatcaaatggtttcatgtattaatagcagttgtatgtgtggtgggccttatcggctttttccataatcattcattgaaaaaagaaacggtcatgaataaagtaagaactgattctcaatatgggaatgttgagatcgcaacgcttgtgaatgacgggaaaacttttaattacgcggttaactatcccgttttcaaaaatgaaaaaatggattcggcattaaaaagattcgcagaaaaagaggttcgtcaatttcaaaaggaaacaaaagacgttgaccaagagcatacgacaaaacgcaacgaattaaatgttgattataaaattgtccattatgccaaacagacagtggcgattgtatttaatgaatataaatacatcggcggggcacacgggcaaaccgtgaaaaaaacgtttaactatgattttagtaaacaagcgtttctttccattgatgatattttcaaagaggacgctgactacttacataagctttcgttaatcgcttatcacgaactgaaaaagaataaggacattgcagcggacgatgcactgttaaaggaagggacggctccgaaaaaagaaaatttcagccgctttgccatcaaggaggattatatcgaactttactttgacacatatcaggttgcagcaggctatcttggagagcaattgattgccattaagaaaagtcttttgaaagacattctgaaagaacaatatattgataaagcaaaaaataaaaataaaatcaaagaacaaaagccgaagcatgaagtgatttctttacccaaagaggaaacggttgatccaaatcaaaaagtcattgcgcttactttcgacgacggcccgaatcctgcgacaacaaatcagattctagactccttgaagaaatataagggtcatgccacgttttttgttttggggagcagggttcaatattatccggaaacgctaataagaatgctgaaagaaggaaatgaggtggggaaccattcatggagccatccacttctcacaaggctttcagtgaaagaagcgttaaagcagatcaatgacacgcaagacatcattgaaaaaataagcggataccgcccgacgcttgtaagacccccatacggcggcattaatgatgaactgcggagtcaaatgaaaatggatgttgcgttatgggatgttgacccggaagattggaaagaccgtaacaaaaaaacaatcgttgaccgtgtcatgagtcaggcgggagatggaagaaccattttaattcacgatatttaccgcacctctgctgatgcggccgatgaaattatgaaaaagctcaccgatcaaggatatcaattggtgacggtttctcagcttgaagaggttaaaaaacaaagagaagcgaaataaattacaaaaggctgtccgtacggacagccttttttctatttaataagagcctgtggtggcccaaacatttaagtttggtcctgaatacttgccgaaagcgtaagaagtccttggatctaaatcatataccatcggtgtatagcaagacttttggccggccaccgcttttccattgccgcctgcagaatcacaattatatctttttccgtctgtgttccgggtaatctccgcatttgcttcataaccagacgtcaatgtattattcatcgtgatttttgcccaagccgttttacatgtactgctgaatttaagctcgactactccgatgacttgattgctggcattcactaagtttgaggatttttttgtagagccgctggacgcacaatcattgtaataagggctttttccatcgtaggcatgggtttccgccttggcgggtgcacctttgacggcaaaaacaaatactactgcgaataacaccaatgaagccttcataaacagtcttttcaatttatgacctccttaatatggcaaacaataaatcatatggaggaacaatcaaaacatgcatgcttttttgtgaacaataaaggcggccgggaggatggagttattggccgcctttggtgtgaggttaagcttttacatcaatggtttgtccgagagtcggatgctgaatcatctttaaggtttgatcggcattttgctgggcggtgtccagcatttttttcgttaaagcgatattaacattctgggcaagggatgcttgatgcattgcaactgataaagcaggaatatccatcgttccacctcctatgccttacctatcggcggctttgtatcattttacagtgaaaaatggcttaattttcgctgttgacccttacgctgcggcatatcgtatgtttttgacaaggagggaatcaggatgaatcttgtaatggaaaagacctttgagcaatacgaaaagctgttttcaatggaagaacagaaaagagaagatgtatttcggtatacgatgatgaggccgtttgaaaagatgtggaccgccatccaagttccgctgaaagcgaaggagccaaacggctatgatgtgatcatggctgcgaaaatgctgggctatttggatgtccgtgatgctgaaagcggccagaaagcactgcaaacatactgaaagaatcacatgtttcagagactgctgaatctgcacttcggcaatgcatattttttgctgagcgcgaacagctgcgggtgaatgcagaggagatcaaattcggcctttatatcgctgatccaaataaacttcagctgcaaaaaggctactgcgggtttggcgggataccgggctttattcatgtatggattgatccgaaccgttataacctgccaaggattccttcaattattgctcatgagtttcatcatcatgtgcggttttcgtatatagattttcatcatggctctgtaagtgtcggggattatcttgtgattgaaggattggcggaatcattcgccagagagctgtttggtacggaacgattgggcccttgagtaactcgttttgatcatgaagatttgcaatattccattgatgtgatcaatgaggtgctggatgtgaaaggattttcggaagtcagccgttatatgtttggtgatccaattgctaacgaccaaggctttaagcctgcaggtttatcggcttttgcggttatgcagttggctatcatgccgttcagtcatttatgaatcaacatcatatcacgataagcgaggccacgcgtttggatgcgaagaccattctttctcagtgcggattgttttccaaatgaaaaaaagcgtcacatacagcggcgctttttgattcccaaaaccagcagttctaaggcggcacaggcggcaattccgattgtatatgcttcgatatcgctccataaaaaaccgtaccccagtacaagtccgccaagagaagtatccctaatctggtcgatccattcggcatgatagagctggctgaattcaatgacaaaacagaaagaaagactgataatgcccgttatcattgtcttcagcttccgaaatagaaatccgcatcccgtaaagatcatggcggcccacaacgagtctcccagataagtattgagggtatcaggaagaacactggagaatgctctggatccaagccctagcccaatgatcagtacggtgaaaactgcatatatccaacgatttcgcttcattgcgaattgataccccgtctctgcttcatctccctgtattgtaaggaatatagcttttatttgtccactaaaaagcggctgaatagccgcgtagggtgtttattttgcttttaggtttacatggtcggctgtctgatccgtgcctattacaaaatggagttcatagcggcctgtatcatatacataatcgatttcatcggtaaacgggacggttaacacccgatttgctggtcctaattgcttctgcagcacttccggcgtaactccgcctaaattcagctgccgttccacaccggttccaaagtagcggatttctgaaattgtcatgtctttatgataggaaaatccgtagcccggctgtcccatattccagtgatataaatcaaatcgattgtctcccccgactggtctttccggttctccaaacgcagcgtggacatccccttttgtgcttttgttaatggtaaggccttgcgcctgctgaggcatttcccctttataggcggtgttatagaggtttttgacaagctcggcggctgattgattcgtgttttctgagagcgtgtttgtttgagctgcggcctttgccggtgctgaaaaggacgcagccccaaagccggtaaaacagcttgttactgctgccgcagcggtaatagcagacattgtctttttcatgttgatccctccttattgatctaccatcccgtttcccggtgttagtgcaataaaacatgtgagtgcgctttgtatgttttattgagttgttgtaagggaactgaaataggtaattcggtatataaagcaagaaaggggaatggagatggctggcaagaaaaaaatcacaataaacggcgttgaaatggaagcgtccgaggaacagacggtgctgcagcttttgaataacagctcgattgaagtgccgcaagtttgctatcatccaagcttaggaccgattgaaacatgtgatacgtgcatcgtcagcatcaatggtgagctgaagaggtcgtgctccgctgaattaaaggatggggatatcattgatacgctctcacctgacgtgaaaaaagcgcaggtcatcgggatggacaagattttatataatcatgagctttattgtacagtttgcgattacaacaatgggggatgcgaaatacataatacggtgaaggaaatgaaaatcaatcaccaaagcattccgtttgatcacaagccataccataaggatgaatcccatccgttttatcggtatgatccagatcaatgtattttgtgcggacgctgtgttgaagcatgccaggacgttcaggtaactgaaacgctgaccattgactgggagcggaaacgcccgcgcgtcatttgggataacgacgtgccgatcaatgagtcgtcatgtgtgtcatgcggccattgttcaacggtctgtccgtgcaacgcgatgatggaaaaaggaatggaaggggaagccggatatttaacaggcatcaataacgaaacgctgcgaccgatgatcgagatcacgaaaggcgtagagacaggctacggctcgattctcgcgatttctgatatggaatctgctatgcgcgatgaacgaatcaaaaaaacgaaaaccgtctgcacgtattgcggcgtcggctgcagctttgatgtctggacaaagggcagagacattctgaaagtagagccacaggaggaagcgccagccaacggcatttctacttgtgtgaaaggcaagttcggctgggatttcgtcaacagcgaagaacgcctgacaaagccgctgatccgtgaaggtgaccatttccgtgaagcagagtgggaggaggcgttatcgctgatcgccagcaagttcactgaattaaaagaggcgtttggcccggattctctcgcttttattacatcttctaaatgtacaaatgaagaatcgtatcttatgcaaaagctggccagaggggtcattggcacaaataatgtggacaactgctctcgctattgccaatctcctgcgactgccggcctgttccggacagtcggctatggcggtgattcaggatcaattacagatatcgcgcaagcggaccttgttttgattatcggttcgaacacgtctgagtcgcatccagtcttatccactcgcattaaacgggctcataagctgagagggcagaaagtgatcgtcgcggatatcagaaaacacgaaatggcagaacgctccgatttatttgtccagccgcgtgccggatcggatatcgtctggctgaatgcgatcgccaaatatttaatagaaaacggcaaggccgatgaacgatttttgagagaaagagtgaacggacgggatgaatatgtaaaaagcctcgcgccgtacacacttgaatatgctgaggagaaaaccgggattgatcgagaaacccttatccaaatggcagagatgatcgggcaagctgacagtgtgtgcgcattgtgggcgatgggcgtgacacagcacattggaggaagcgacacgagcacggcgatctctaacctgctgcttgtgacaggaaactacggaaaaccgggagcaggttcttacccattgcgcggtcataataacgtgcagggagcaagtgacttcgggagtatgcctgacagaatgccaggctatgaaaaagtgacggatgaacaagtccgccaaaaatacgagcgtgtgtggggtgtgccgctgccgaaagagccgggtatgaccaaccacgaaatgattgaaaaaatccattccggacagctgaaagcgatgtatgtaaaaggtgaagaaatgggcctggtggattccaatatcaatcatgtacacgccgcatatgaaaagcttgatttctttgtggtgcaggacattttcctttcacgtacagcggagtttgctgatgtggttcttcctgcgagcccaagccttgaaaaagaaggaacgtttacaaacacagaacgccggattcagcgtttgtatcaggtatttgaaccgctgggtgaatcaaagccggattggcagattattatggaggttgccaataagcttggcgccgactggcactataagcatcctgcagacattatggaggaagcagccaagctgtcgccgatttatgccggtgtcacctatgaacgtcttgagggctataattccctgcaatggcctgtaaatgctgatggaaaggattcgcctttactctttacagagcgcttccctttcccggacggcaaggccattctctaccctgtccagtggacagagcctgaggaattcggtgaggaatatgatatccatgtcaacaatgggcggctcttagagcatttccacgaagggaatctgacttacaaatcaaaagggatttcggagaaaacaccggaagtgttcttagaaatttctcctgagcttgcggcagaacgagggattcaggacggaaccctcgtcaggctcacatcgcctttcggaaatgtcaaagtgaagtgcctgattactgatcgagtcaaagggaaggaagtatatctgccaatgaacgattcaggggaagcggcgatcaacctgttaacaggcagccatgccgataaggataccgatacgcctgcttacaaagaaacatcggccaagatggaaattttgaagcacgacggaatcagcccgctgcctaagatcaaccaccgcaacggcaatccgcaaccgcaaatcggtgtgcaggttcaaaagaaatgggcgcggaaggattatattttccctggtgacgctgtgaaaagggggatgggccataatggctaaagcgattaaacgaatccaaaaaatcgaggtaacagaagaggatcagcgaaagcgtgatttgcgggaaattgaagatgctctaattgaccacaaagaagcgattctcgaaacattgcatatgctgggccatatgaacgagcgcggtgtcctgccgttgctccgcggcctttttggtcaaggggataaagttcttgatatcctggtgaaaaaggcagatacagaggaaacagccaatacgctgaaaaatctgcttcttctgtttgggacactcggcatgctggacgtgaagcagctggagcctctcattttgaaagtgaatgcgggtgtggcaagcgctgtagagcagaaaaacagcgaagaaaagacaggttattttgatattatccgctcgctaaaagacccggaaatcaacaaatcaattacactgctcttttcctttttaaaaggaatgggacaagatacaaaggagctggaacgcacgacgcagcctccggaacaccaaaaacatcatcaggaacctcgagagaaaagaggaatgaacaagcgagattgacctcccgcccgagcggcttcagccagctcgggttttttgatgaaaaggtctaatggactagtaaaaaatattcaaatactaggaagaagtaagattgtgatgaatgagatagaaataatcgttactttcttacctgttaagaaaaggaaaaatctgattataatagaaatcgattactttagatgggggaacaatcatgaaaaaagtcttattactattatttgtcttgacgatcgggttagcgctttcagcgtgcagccaatcgagcgatgcgtcagagaaggaaaaaccgaaagagaaaaaatcgcaagaagagcttgaaaaggaacttgataaggaattgaaaaaaggcggtgagccgaagaccaaaaaagatgatcaaatacataaaataggagaaacaattaaagtaaatgatattaatttcacggtgaataaagtggatcgtgaacagaagggccaatatggagatttgggtggaaaagactatgataaaacaaaaacagtaaaagataatgaagagcggttaattatagaagtgaccctagaatacgttggaaaaggttcaatggaatacaaccgattaggattagatctgaaagacaagaagaataaatcagttcgctcagtcatttcattggaggataaaggaaaaatgtttttggggggaatctggcgtcaggaaaaaaggtgacaggagtagttagttatgtaatacccaaaggggaacagaaaaattacacattagtgtataacccttttttaatagatactggaagtgatagaattgaagaaagcgcaaaatacaatatagattatttgataaaattagaaaaatagcattaaaaaaaagcacgttttcatcagggaagaagcgtgctttttttatagtgacaaataatgtgaaggggagagtgataaaagtgcaaaccaaatggctggaacgggcacagcggattcaagcgattgcacaggctgggcttgctttttccaaggatgtgtacgacagggagaggtacgaagagctaatgaagctcagtgcagaaatgatggtggattactcacagacggacattgaagttataactgatttatggaatggggagagcggctatccaacaccgaaagcggatgttcgcggcgcagtattccgagagaatcagattttgcttgtccgggagaagcatgatgagctgtggtcgctgccgggtggattttgcgagattggtttatcgccagctgaaaacgtcgtcaaggaaatcaaagaagagtcggggtacgatacagagccgtctcgattgctggccgtgctagacagccataaacactctcatccccctcagccttatcactattataaaatcttcatcgcatgcagcatgacgggcgggcagggggaaacagggatcgagacgaatcatgccgctttttttccggaagacagcctcccgccgctttctcccaaacgaaacacaccctcacagcttagcatgctgtttgactttttgcgccatccggacaagaaaacgatatttgactaaaaaagaaagagcctatgggctctttcttttttaaaatgtaatgtgtttctcgttggcgagtttcagaagggtcaaaatagaatcggcttgtttatggccgagtttttgctttaatttgttttcttcaactaatcggctgccataaattttgacagaggctttgtcgacgacagtatgccagttttcctgtttttttccctcaacaagcggtttttcatgtctctcagaaaaagagaacacaaagagtacgaatgcaagtgaaagtaggattccgacaacttgttttttgtaatcagtctgtgctgccacgttgttctctccttcaccttttaccttctatttaatcatagaaccaaattattttacataatgggaaagtcatttttggagttagtgcatttggttgaaaacagtgacgttttttgagcggagcggtgcaattgaatccatattggatttgcgtgcttatgcctaaggtcacgttgtgagccaaaacagcagtgcagaatagaaaaaaattgaaagattatggtaagatgaacgaaattcgagggggaatatatgatgcctgcatcgaacatcgtgatcgcctgcctgctgttatcaatttaattatttgtggtagtccctctctttttcgaaagcgggaggtgaagtggaacattcattgctgaattttttcaagggagtgaccataatgagtgtgttaaaccgccggcaagccttgcagcgagcgctgctcaatgggaaaaacaaacaggatgcgtatcatccgtttccatggtacgaatcgatgagaaaggatgcgcctgtttcctttgatgaagaaaaccaagtgtggagcgtttttctttatgatgatgtcaaaaaagttgttggggataaagagctgttttccagttacatgccgcagcagacaagctctattggaaattccatcattaacatggacccgccgaagcatacaaaaatccgttcagtcgtgaataaagcctttactccgcgcgtgatgaagcaatgggaaccgagaattcaagaaatcacagatgaactgattcaaaaatttcaggggcgcagtgagtttgaccttgttcacgatttttcatacccgcttccggttattgtgatatctgagctactgggagtgccttcagcgcatatggatcagtttaaagcatggtctgatcttctggtcagtacaccgagggataaaagtgaagaagctgaaaaagccttttggaagaacgagataagtttgaggaagaactggctgcgttttttgccggcatcatagaagaaaagcgaaacaaaccggcgcaggatattatttctattttagtggaagcggaagaaacaggcgagaagctgtccggtgaagagctgattccgttttgcacgctgctgctggtggccggaaatgaaaccactacaaacctgatttcaaatgcgatgtacagcatattagaaacgccaggcgtttacgaggaactgcgcagccatcctgaactgatgcctcaggcagtggaggaagccctgcgtttcagagcgcccgccccggttttgaggcgcattgccaagcgggatacggagatcgggggcacctgatgaaagaaggtgatatggttttggcgtttgtggcatcggcaaatcgtgatgaagcaaagtttgacaggccgcacatgtttgatatccgccgccatcccaatccgcatattgcgtttggccacggcatccatttttgccttgtggccccgcttgcccgtcttgaagcaaatatcgcgttaacgtctttgatttctgctattcctcatatggagtacgtcagtatcactccgattgaaaacagtgtgatatacggattaaagagcttccgtgtaaaaatgtaatagataaggagactggagattcatgaaaaagtaccatatttcgatgatcaatatcccggcgtacggacatgtcaatcctacgcttgctttagtagagaagctttgtgagaaagggcaccgtgtcacgtacgcgacgactgaggagtttgcgcccgctgttcagcaagccggtggagaagcattgctctatcatacatccttgaatattgatcctaagcaaatcagggagatgatggaaaagaatgacgcgcccctcagccttttgaaagaatcactcagcattctgccgcagcttgaggagttatataaggataatcagcctgatctgatcatctatgactttgttgcgctggctggtaaattgtttgctgaaaagcttaatgttccggtcattaagctctgttcgtcatatgcccaaaatgaatcctttcagttaggaaatgaagacatgctgaaaaaaataagagaagcagaggctgaatttaaagcctacttggagcaagagaagttgccggctgtttcatttgaacagttagctgtgccggaagcattaaatattgtctttatgccgaagtcttttcagattcagcatgagacgttcgatgaccgtttctgttttgtcggcccctctctcggagaacggaaggagaaagaaagcctgttgattgacaaggatgatcgcccgcttatgctgatttctttgggtacggcgtttaacgcatggccggaattttacaagatgtgcatcaaggcatttcgggattcttcatggcaagtgatcatgtcggttgggaaaacgattgatccagaaagcttggaggatattcctgctaactttaccattcgccaaagtgtgccgcagcttgaggtgttagagaaagctgatttgttcatctctcatggcgggatgaacagtacgatggaagcgatgaacgcaggtgtgccgcttgtcgtcattccacaaatgtatgagcaagagctcactgcaaatcgggttgatgaattaggccttggcgtttatttgccgaaagaggaagtgactgtttccagcctgcaggaagcggttcaggctgtatctagtgatcaagagctgctcagccgcgtcaagaatatgcaaaaggatgtaaaagaagctggcggagcggagcgtgcggcagctgagattgaagcgtttatgaaaaaatctgctgtcccgcagtaaaaacataaaaaccgaaatcaatttgatttcggttttctgtttaaatattttttttcatcccgcatctccggcattctctaagaaattttccgccttttacagagcttttgaacagtgtgtaatcacagttgtcgcagcgcccgctgcgggcatccggatattcattgaattcgtaaacaatcgatgtatcgtagccttttgtttcatattcttctttttttgtatccatgtcgatcctccgttacaagacgtgtctgctgtttatcttacagcaagcttccggcgtattcaatggattttaggaggttgggtttatcttgatttctcccttggtttgcgccacaatagctttattaagcttgtatacataaaaagcctatgcaaagaggagaggaaacgggtatgggaaaagggttacttggaaaacgtgtggcaatcggtggctcacgaaaaacggaagaaatcagtacaatcattgaaaaacagggcggaatccctgtcatccggcctctccaaggtacagtttacttagcagagaagcaggtggagccggatttgcggacgtttgcggaagaaaaagctgactgggtcattttcacgacaggcatcgggttggagactcttgtcgatatggcagagaaaattggactgaaagatgagtttctgcaggccattcgccaagcgaaagcggcatgccggggatacaaaacgctgtctgcgttgaaaaagcttgggatcacaccggaagcttcggatgaagacgggacaacaagaggcttaatccgttctttggagcctcacgacttttcaggaaaaacagtcatggtacagcttcatggcgaaaaagcgccggttctcatggcatttcttgaagaaaaaggcgcgtctgtcctgccgattctgccttatcagcacatcccgccggaggaggaaacggtggagcggttatgccgagagctgatgaacggtgagatcgatgccgtttgttttacaacggccattcaggttcgttccctgtttgattttgctaaggggcgaggttatatcaatgaagtgaagaaggtattcgaagaatgcgccatcgcagctgctgtcggaaaagtgactgctgaagcactgcgggaagagggcattacgagactgcttgcgccagagattgagcggatgggtgcaatgattgttgagctggccaagtattatgaagaaaaggaataacaagtacaaaaagccgcttttccctcggaaagcggcttttgtctgtcattcattctgcttcagctgctgatgaacggtgaataatgatgggtatgtcagcacgcttaagattacacaagtcagcgcggctgaggccatcgttgtaaacacgattaagagctgaaagcgtactgcctgaatcgggtccgcgccggctagaatctggcctgtcatcatgccgggaagctggacaagacccagtgttttctggctttcgagcgtcgggatcatactcattttcatcgctgaagtaagaatgcgctgtatggattgcttcggtgtgccgccaagtgacaatattaattgaatttcttctttgcgaatgccgacttctgagttaagccggtttagaaacaaactcgagagcaccatcgaatttccgatgaccatcccgctgatcggaatgacatatcgtgccgtaagcggaatgatatgaagagacagcagaattccctgcgtcacaatttctacgattgctaacgcggcaaacaccctccaaaacgaaccgatagtatttttctttcgcttgatgacattttgtgccgccaccgcgagcattaacagcaccatcagcaggataaaaacagggtggtctccgcgaaaaatcagcgacaaaacataaccgatgataagcagctgcaccgcggcccggatggtggcgatgatcatgtctttttctacaccggctttaaaggattttgataaaaacaaggcgatcaaaacaaagatcatcgttaaagagagagaaaggtaatccattaccgagtgcctcccttcaaaaattctttcgctgcttcatgctgcggagcggagaaaaatgtttcggtttcagcgatttcaagcagccggccatctgccataaaccaaatggtatcggctattcgttttgcctgctccatattatgagtgacccacatgactgtccattttttctcttgatgctgacgtttgatcagttcttcaatctcaagagcagaaaccgggtccaaggccgatgtgatttcgtccaacaatagaatggaggaaggatttgagagcgttctggccagtgacagtctttgccgctgcccgcccgataagtctctggcgcttctgtctaacaactctggcggcagccctgcaagagaagccagcttttcaggagagtacagctgggattgatgcagcctttgtacaagacttaaattgtcacgcactgtcccgtcgagcacgggagccgattgaaacgcgagggctgccgttcgcctcagctcattgacattccattctctgacttcttttccgtatatgttgacttcgccgctgtcaggcgttctcattaaattacacatagaaaggagggtgcttttgcctgagccggaaggacctaaaacggctacgatttcgccctgttgaatgtctccggtgacatcctgcagcacatcataggtttgtccatcttgtttatagctttttcggactgatctgaaggagatggctggtatgttttgtgtttgatcgtttgcttccattacaataatcacctttcaatataagtaggctgacattatatttaactataacgtgaaacagatcccttttggtagcacaaataaaggagaacaggctttcacccattctcctgcagatgctacgcagtcagatttgactgtgctttctttttcggttttctcggctgtgaagcgaaggtatgtaacatcatccccgctattataatgaacaaaccggcaaatgataatagagatgggaaaacgcctgacagcagaacaatttcaccaagcagcgcgaaaatcacttcaccggattgagtggcttcaacagctgcgagtttttgcggattgtctcttaccatatcagtggcccagaaaaataaaaccgtcgcaatgatgcctgagctgacggcaacgataaaggattgaacggtttgacttgctgttggaaggccatctgaccaccagccgtaagctgctaatataagccagaatggaaggcttgccaatgtcattccaagcacgcgctgaaatgtatcaagccggcctccgtattcttcgagcattctcctgtttcctaacggataggcaaaagccgcaatgacaaccggcagcacactgaaaagcagcatcctcccagaaagcgattctgcatgctgaagctgaatcagagccgctccaaccaggatgatcatggaagtgccaagtgaaaccaggggaatcttttggcgaacgagctgcggaccgcccggcatatcttgtttgacataaaacaaaggagataagagcaccccggctacaattgtaatttgccaggttccggctatgagccaccccggaccgtatgcagccgcaaatgtaatcggcgcgtaaaaaagcacgaagccgacgaagctccatttgatccaataaaacggctttttcctcatctctagtaagagaggcgtgaatgtccctctcatgatgacaatcaaacataaaaacggcaccataaaaataaagcgcagcgaagagctccaaagccagctgcctcctgataactccatcgctctgtttaatataaaggtaacggcgaaaaagagtgaagccaatattccgataacgatagctttcatgatatccctcattctggcattatttttttatactatactattcggtatcatgcagatcaatggaatcatgagaaaaacatcatgttttgcgaaccgctatgtgtggaagacaaaaaagggaggtgtaattgatggaaaaagagacacagacatacttctttccggatgacggcaggattccgaatcaccctgattttccgctcgtggtgtatcaaaacgcgcttaaggacaccggactggcagagcggatcgtcatccggcatggctggtcaaacagctggtcagggagtgtttttccataccatcattatcacagcaatacgcatgaagtcctgattgcccttaggggagaggctgtgattcagtttgggggagaaaaaggggctgccatccctttcaaatcaggcgacgcagtcgtgattccagccggagtcggacataaaaagctcagctcaagtcccgattttactgtccttggcgcctatcccggtggcgttcagtatgatatgaagacggggaaaccgtatgagcgggaggaagcgctcaaacagattaagcaggtggcgttgccggcgaatgatccgatcacaggaaaaagagagcctctattggaaatatgggtaaagtgaaggggagaaattgctggattgtcaataactagtgccgcagaaacgatatgacatgagctccatataaattaatttcataatcgaagcaattcacgttcaaattttgttcaaaaagtgttatcatatagaaggtaatcgaattggagttttttgtgtttgctattttcagagagagtaaaggattttgacttattcaattgtttatttttagataaaaataatactgaatatggcaagatgaaaaactgggtagtaaacatttatttttgtaaatgattgtgcacgaattcacaatccttattcttatgccttaaaagcgtgagacagggagaggcactaccctttccaaaaaatcagcaaactgcttatagtaaaggagaattggatatgccagaaacaatcgatcaaacaaatgcgtctgtcagccaaagccagcaagatcttattgatcagctattaaagccagaagttcaagaatcattgactgttttagttgaccagcttccgaagctgactgagttagtgaatattttaacgaagtcttatgatttcgctcagtctgtagcgactgacgaagtgttaaaaagcgacacagtcggtgcgatcactgaaattcttgagcctgtaaaagaaacagcgaaagaagtagctgcgactgcgatcgaagcaaaagaccgcgcggaagcaagcaacgaaacaattggtcttttcggcctattgcgtatgctgaaagatcctcaagctcaaaagctgttccgttttgctaacagctaccttgaagtcatgaacgaacgcgaaaaccaaaaataatctcagattcaaaattgatataaaggacggaggatatacgatgtcaaaacatattgtcattctaggcgctggttatggcggagttctttctgctctaacagttcgcaaacattacacaaaagaacaagcacgcgtgacagtggtaaacaaataccctactcaccaaatcattacggaattacaccgccttgctgcaggcaacgtgtctgaaaaagcggttgcaatgccattagaaaaacttttcaaaggcaaagacattgatcttaaaattgcggaagtaagctctttctctgttgataaaaaagaagttgcgcttgctgacggttctacattaacttacgatgcgcttgttgtaggtcttggttctgtaacggcttacttcggcatcccaggtcttgaagaaaacagcatggtattgaaatctgctgctgatgcgaacaaagtcttccaacatgttgaagatcgtgtgcgcgagtactctaaaacgaaaaacgaagcagatgcaacaatccttatcggcggcggcggcttaacaggtgttgagcttgttggtgagcttgctgacattatgccgaaccttgcgaaaaaatacggcgtagaccataaagaaatcaaattgaaacttgttgaagcaggtccgaaaatccttcctgttcttccggatgatcttatcgaacgtgcgactgcaagccttgaaaaacgcggcgttgagttcttaacaggtcttcctgttacaaatgtagaaggaaacgtaattgatctgaaagacggatctaaagttgttgccaacacatttgtttggactggcggcgtacaaggtaacccattagtcggtgaatcaggtctagaagtgaaccgcggacgcgcgactgtaaatgacttcctgcaatctacatctcatgaagatgtattcgttgctggagacagcgcagtttacttcggtccagacggccgtccatacccgccaactgcacaaatcgcatggcaaatgggtgagctgatcggttacaacctattcgcttacctggaaggcaaaacgcttgaaacattcaagccagtaaactctggtacacttgcaagccttggacgtaaagacgcggttgccatcattggtgctaattctacaccgcttaaaggtcttcctgcttccttgatgaaagaagcaagtaacgtacgttacttaacacacattaaaggacttttcagcctggcttactaatccttttaatgaatctgacattgccaaaagcgttccttaccgagtgctttctggcaatgtctttttttatgtttatgacaacgttaacatttcattttcaaaaaagagattgatcccagaggaatataaaggtaaaataaaaacaaatcaaaatgttaacgttaacattttgaaatagaatgaaagatggtgaggacatggaacccttcatgggcgaaaattttttattgaaaaatgaaaccgctgtcagcctctatcataattatgcgaaagacatgccaattattgattaccactgccacttaagtccgaaagaaatctatgaaaataagacatttcaaaacatcacggaagcctggctgtatggtgaccattataaatggcgcatcatgagagccaatggaattgaggagacatacatcaccggagatgcgcctgatgaggagaaatttatggcttgggcgaaaaccgtgccgatggcgattggcaatccactctacaactggactcacttagaattacagcgtttttttggcatttatgagattttaaacgagaagtccgggccggctatatggaaacggacaaatgaactgctcaaaggagaaggcttcggggcaagggatttaattgtgaaatcaaatgtaaaagttgtgtgcaccacagatgaccctgttgattctcttgaataccatctattattaagagaagacaaagactttcctgtcagcgtgctgcctggatttcggccggataaaggacttgagatcaatcgtgaaggctttcctgagtgggtgcaggcgcttgaagatgccgccgccatatcgattacaacctatgatgagtttttaaatgcgttggaaaaacgagtgcgattcttccactcagccggcggcagagtttctgatcacgcgatagattcaatggtatttgccgaaacaacaaaagaagaagctggacggattttttctgacagattacaaggaacagaggtttcttatgaagatgagaagaaatttaagacacatacgcttcagtttctttgcggtttgtatgcggagctcgattgggcgatgcagtttcatatcaacgctttaagaaacacgaatacaaaaatgatgaaaaggctcggacctgatacaggctatgattcaatgaacgatgaagaaattgctaagcctttatacaagctgctgaactcagttgagatgaagaaccagctgccgaaaacgattttatattcattgaacccaaatgataactatgtcatcgccagcatgatcaacagttttcaggacggtattaccccgggaaaaatacaattcggcacagcctggtggtttaacgatactaaagacgggatgctcgaccaaatgaaagcgttatcaaatgttggccttttcagccgttttatcggcatgctcaccgattccagaagctttctttcgtatacgcgccacgaatatttcaggcggatcgtctgcaatttgattggagaatgggtggaaaacggcgaagtgccgcgcgatatggagcttctgggaagcatcgttcaggggatttgctatgacaatgcgaaacactacttccaatttcaagaagagaaagcaaacgtgtaacaaagtgtccgctcagcatcgctgagcggatcactatccgaaaattcttaagacacagaggtggaacatgcgaactgaactggcaaataaggttgtgtcggtcgaaacggaaaaaaggctttcattgaaagagaaaatgtcctatggttttggtgattttggcaacggttttatgtttgatctcggccagatttatttattgaagtatttcactgatgtagcgggaatccccgctgcgatggccggcggcatttttttagtcagtaagctgtttgcagcgataacagatccaattgtcggctcatcaatcgattatcgcaaaaatatcggcaaacgggggaaattcaggccttatctattaatcggcagcatcgtgcttgcggtgcttactgttcttatttttctgtctcccaatgtatcaacgaccggaaaactgatttatgcatatgcatcctatatgatttggggcatcggctattcgtttgtgaatattccgtacggctcattaggggcagcgatgactcaaaattctgaggaccggacctccatttcgacgttccgccaaatcggatcacttggcgccttgtttatcacaagtgtggccgtgatgccgctgctcgtccagtttgataatccgaaggtcggctacccagtggtcatgggcttgttcgccgcgctcggtgtgttttggttttatatttgctaccgcaactgcaaagagcgcattgtcatatcggaagcaccaaaagaaaaattaacactctcatctgtcgtcaaaacatttattacaaataaaccgctgttaacccttgtcctgatgacgattttttcaatttccgcatacaacattaaatccgccatgctcgtctatttcgcacaatataacttgggcaatgttgaattaatggcttatatgaacttcatcattattggttcttcctttttgggcgtcgtattccttccaaagctcgtcaagatgtttggaaagaaacgaacggcaatgatcggcttcggcatcagtgtggccgcggatctgatcaactttatgctcccatctaacgtatatgtgtttacaattctcgccagtatcgcctttatcggaatcagtatcccaaatggcatcacgtgggctcttgtctccgatattatcgactatggcgaatggaaatccggtgaacggaaggaagcaacgacatattcacttttcaatttctcaagaaagcttgctcaatctttgtctggctttctctcggggatcggtttggggattatcggctatgtcccgaatgcagtccagacagcacaggcgctgattggcatcaaagcgcttctgcttctgtatccggccattgctttggcattagcgatgatcattatcggctttctttataaactcacagaccagcagcatgctcagatcgttcaggatcttcagcaaaagatctgacaatataatatagagaatatttaaaataatttgtaaataaaatgtgtttgtaggggttcgctaggagagtgcccaaaaaactgaaaaggaaggaggcacttgcttgaaaacgataacaattgcagctaaagaagcaaaggaactcgttcggcaaaagctggccagtgccggtttgaatgaacgagatgctgaaaaagtagcagatgttctcgtacacgctgatttgcgcaatgtacattcgcatggcgtgctgcgcacagaacactatgtgaacaggcttttagcgggagggatcaatcctggggcacagcctgtttttaaagaaacggggcctgtgaccggggtgcttgacggagacgatggtttcggtcatgtgaattgcgacatggcgatggaccatgcaattgacatggcgaagaaaaaaggagtcggcatggtcacggccgtaaacagcagccattgcggagcgctaagctattttgtgcaaaaagcggctgacgaaaagctgatcggaatagcaatgacgcatacagacagtatcgttgtcccgtttggggggaggactccttttttagggacaaatccgattgcttacggtgttccggctaagcataaaaaaccgtttatcctagatatggcgacatccaaagtggcttttgggaagattctgcaggcccgtgaagagggcaaagaaattcctgaaggatggggagtcgatgaaaacggagaagcagtaactgatcctgacaaggtcgtctcactttcaacattcgggggcccgaaaggctatggactatcgattgtggtggatgtgttttcaggattgctggcgggcgcggcttttggccctcatattgccaaaatgtacagcggccttgatcaaaaaagaaagctggggcattacgtttgcgcgatcaatccagccttttttactgactgggatacgtttttagagcagatggatgccatgattgatgaactgcagcaatcaccgccggctgttggattcgaaagagtgtatgtgcccggcgagatcgagcagctgcatgaagaaagaaataagaaaaacggaatttctatcgctcggagcgtgtatgaattcttaaaaagcaggtgagtaaaatgaaagcggttcaagtgcgaaaagcgtatgatctggtgacagcggaggtgaagaagccagttctttcaaaggatgatgaagtgctcgtgaaagtcaagcgagtcggcatttgcggttcagacatgcacatttatcatggaacgaatccgcttgctaccctcccgagagttatcggacacgaggtaacgggactagtggaggaagttggtgcgaaagttcagagcctaaaacccggtgaccatgtggtgattgagccgatttcttattgcggcacatgttacgcctgccgcaaagggcggccgaatgtttgcgccaaggtttctgtatttggcgtacatgaggacggaggcttgcgggaatatattgtgcttccggaaaggcagcttcacgcggtctcaaaggacttgccttgggaggaagcggtcatggccgagccttatacgataggcgcccaggcagtgtggagaggccaggtgaaaaaaggtgataccgtcctgatccagggagcggggcccatcgggatctgtgtgttgaaaatggcaaagctggcgggcgctgctgtcatgatgactgacttgaacaacgagcggctggcatttgcgaaagaaaacggcgccgatgctgttgtaaatgtccaagcagaacatgttgccgagcgtgtccttgaatggactgggaatgaaggagcaaacgtggtcattgatgctgtttgcctgccggagacttttgcactttcaattgaggctgtgtcaccggcgggacatgtggttgtgcttggatttgatgaaagagcggctcagatttcacagctgccgattacaaaaaaagaagtcacgataaccggatcgcgattgcagaccaatcagtttccaaaagtagtagagcttttgaatggaggccggttagtgcataacgggctggtgacccatacattttcagttgatgacgttcatcacgcatttcagtttattaaggagcatccagatcaggtgcggaaagccgtcatcacgtttgattaaatgactgaatccggaggtgcgagcatgaatatgacattccgatggtatggacgaggcaacgatacagtcacacttgaacacgtgaagcaaattcccggagtcaaaggcatcgtttgggctctccatcaaaagcctgtcggcgacgtgtgggaaaaagaagaaatcagagccgagaccgaatatattcaatcctatggttttcatgctgaagttgtagaaagcgtgaatgttcacgaagcaattaaacttgggaacgaagaacgcagccggtatattgaaaactacaagcaaacgatccgcaaccttgccggatttggcgtgaaagtgatctgctataattttatgccggtttttgactggacacgcacggacatgttccggccgctagaagatggatcgaccgctctgttttttgaaaaggccaaggtggaaagccttgatcctcaagagctgattcggacggtggaggaagcatctaacatgacactgccggggtgggaacccgaaaaattggctcggatcaaagagctttttgctgcctacagaacggtcgatgaagaaaagctatgggacaatttatcattctttttgcaggaaattcttcctgttgctgaggcctatggtgttcaaatggccattcatccggatgacccgccgtggccgattttcggactgccgcgcattatcacaggagaggcaagctataagaaactgcgggcgatatcagattcaccgtctaattgtatcaccctttgtacaggttcaatgggagccaatcccgctaacgacatggtggagatcgctaaaacgtatgccggcatcgctccattttcacatattcgcaatgtgaaaatttatgagaatggtgattttattgaaacatctcatttaacaaaggatggttcgatcaacattcaaggcgtgatggaagaactgcataagcaggattacgaaggatatgtcagaccggatcatgggcgccatctttggggcgagcaatgccgcccgggatatggcttatacgatcgggcacttggcatcatgtatttgaacgggctgtgggacgcctatgaagcaatggcaaaaaaagaggtgggcgtatgatcccgctgcatgagaacctggctggtaaaacggctgtcatcactggcggcagcggcgtgctttgctctgcgatggcacgggagctagcccgtcatggcatgaaggtggcgatattgaatcggacggctgaaaaaggccaagcggtcgtgaaggagataacggcggctggcggcacagcgtgcgctgttgctgcggatgtgctggacaggatgtcactggagcgggcaaaggaagacatccttggccaatttggcgctgttgatctgttaattaacggggctggcggcaatcatcctgccgcgataaccgatgtggagacatatgaagaagcgggagaaggccaatccttttttgatatggatgagaggggctttctaactgtattctccaccaacttcaccggtgcgtttctggcctcgcaagtgtttggaaaagaactgctgaaggtggattcacccgcgattatcaatttttcttcgatgagtgcttattcacctatgacaaaggttccggcatacagtgccgctaaagcatcgatcaataattttacgatgtggatggctgttcattttgccgaaaccgggctgcgggtcaatgcgattgccccaggcttctttctgacaaaacaaaatcatgatctgctgatcaaccaagacggaacgttcaccagccgatctcacaaaattattgcgggaacaccgatgaagcgcttcggaaaacccgaggatttgctcggtacgcttctttggctggcggatgaatcctattccggttttgtcactgggatcaccgttcctgtcgatggaggatttatggcttattcaggtgtgtaacgaaagcggtgcaacagaaactgaaccaacataggggtgaggttgagatgttttcaaaagataagcttcccgttatcctttttttgttcctggcaggggtgattaattacctggatcgctcggcgctttccattgcagctccttttattcaggatgatctcacattgtctgcaacgcaaatgggcttgattttcagcagtttttcgattggttatgcgatttttaactttcttgggggcgtggcatccgaccgctatggggcaaagctaaccttgtttgtcgcgatggttgtttggtcgctgtttagcggagcagtcgccctcgcttttggctttgtcagtctgctgattatacgcattctcttcggaatgggagaaggcccgctttcggcgaccatcaacaagatggtgaacaactggttcccgccgacccagcgggcgtccgttatcggtgtaaccaacagcggcacgcccctcgggggagccatttccggcccgatagtcggcatgatcgcagtggcgttcagctggaaggtatccttcgttctcattatgattattggattgatatgggcagtgctctggttcaagtttgtcaaagaaaagccgcaagagacgatgaaggaagcaccggcaataaaagcagaaacgtctcccggagaaaaaattccgctaaccttttacctgaagcaaaaaacggtcctattcacggcgttcgcttttttcgcttacaactacatcctcttcttctttttgacatggtttccgagctatcttgtcgacgaacggggattaagtgttgaatcgatgagtgtcatcacggtcataccgtggattttaggatttatcgggctggctgcgggaggatttgtttctgactatgtgtacaaaaaaacggcccgaaaaggtgtgctgttctcgcgcaaggttgtgcttgtcacgtgtttgttttcatcagctgtcctgattggttttgccgggcttgtggcaacgactgcaggggctgtcactcttgtcgctctgtcagtgttctttctttatttgaccggtgctatctattgggctgtcattcaagatgtggttgatcaaaacaatgtcggttctgttggcggcttcatgcatttcctcgccaacacggcaggaattatcggcccggctctaaccggatttattgttgaccaaacaggcacgttttctggagcatttttgcttgccggagggctggctgtcttcgcttcacttgctgtgattcgttttgtccgtccaatcattggcaagccagcgggaacagaagctgagaatcctgtgtcttattaatctggaaatatagtgggagaggcggtatgtttgatgatacaatatacagtaaataatcgcagccggtatgataaggaagggaattagatggtaaccataaaagatatcgcaaaactcgcaaacgtatcccacacaaccgtttccagagcactcaacaacagtccttacatcaaagaacatacgaagaaaaagatattagagctagcagagcagctcaactatacaccaaatgtaaatgcgaaaagtctggcgatgcaaaagtcgcatacgatcgggctgttctttacaagcattacaaacggaacttcacacagcttctttgcagacacaatcaaaggcgtcaatcaagccataagtgaggattacaatctgtatgtgcgcggcattgatgatctgaaaaactatgactccgttacaccgatgagatatgacggcatcattttaatgagccaaagtgacattgataattctttcatttaccatattcgcgaaaaaaacattccgcttgtcgtgctgaatcgtgatattgatgatcgcaccatcacgaatattttgtccaatgacaaggaaggctctcaagaagctgtagaatacttcattcagtccggccatcaagacatcgccatcatcgaggggatcgaaggctttaaatcctcccagcagcgaaaggaaggctacttatctgcactgattcaacatcatattccgatcaagcatgaatacagtgtcaaaggacagtacgatatggaaagcggctttcaagcgatggagaggctgctggcactgccgaatcctccaaccgctgttttttgttcgaatgatgacatggcaatcggagcgatgaatgcgatattcgcaaagggcctgcgcgttcctgatgatatttcggtgatcgggtttgatgatattgggttttcacagtacatcacgccaagacttacaacagtaaagcgcccagtggagaaaatcagcgtgctcggtgcgcaaaaactcttgtctctgatcagcgagcccgaaacaaaagcagaaaaaatcttggaaaacacagaattcatggtgcgtgattcagtcagacgattgacgacgtgatgtcccgtttttcagcgggcattctttataaagaaaaatgttaacgtgtgcataaaaggagagggaggcaatacgggtgcagaagctgaataaaaatgtgtacgatcactatactcagtatccagaaaaaattctccagttcggagaaggaaactttcttcggggatttgtcgattggcagattgatcaattgaatcaacacactgattttaatgggagcgtggcagttgtccagccaagaggctcagaaaaaatcaaacgattaaatcagcaagatggattatatacgctttttttacaaggaatgaaagacggagaagcggtaaacgagcatatgattatcaactcaatcagccgggggattgacctgttttctgattatgaagcatacaaagaattggcatcaagcgaaaggcttcggtttatcatctccaacaccactgaggctgggattgtatgtgatgaaaaagatcgtttagaggataggccgcaaaaaacattccctgggaaattaactgcatttctctacttccgctatcaggcttttaaaggagatcagacaaaagggtgtgtcctaatcccatgtgaactgattgagaacaacggcgaaaagctgaaggaaacggttcttcattatgcaggtctgtggaagctggaggaaggatttacacagtggattcatgaggccaatacattttgtaatagtttagtagaccggattgttccgggttttcccgtcgacagcattgatgagatcacggcggatcttggctatcaggatgatttgatagttgtgggagagcaatattatttatgggttatcgaggggcctgattggattggaaaagaacttccctttgcggctgcagggctccatacaaagatcgtcagcgacctcaccccataccggactaaaaaagtaagaattttaaatggcgctcatacagcaatgacgccagtggctttattatacggcttaaaaactgtttgggatgctgtcgagcatccggaagttgggcgatttataagagagctgattgacgacgaaattcttcctgttttaaaaatggaaggtctttttcagtatgctgacgatgtgctgaaccgttttaaaaacccgtatattaagcattacctggaaagcattgcattgaactccgtttccaaattcaaaacgagaaacctgccgactcttaaggaatatgctgaacaaaagggacagcttcctgaacgcttggtgttttctttcagcgctcttctgtatttttatcatgataacgagacattgcaggatgatccggcagttcttcaatttttcaaagaggtttggtgtcaggaggatggcgacatgcttcggattgcatcaagagtgttaggcgaacagcggctatgggggcagatctcaatgagataccgaagctgactgatagagtcgctgtttacttgaatcttattcatgagctgggcatgcagcgggctcttgaacaatactgcatacaagggggagaggtacgttgaagtcgtttataaagattcataagcaagataatgtccttcttgctctgcgggatatccaaaagggagagaggctgcatgcggacggcgtgtcgattgaagtaaaggatgatataaaaagaggccataagattgcattgcagcctattaaagaaaacgacagcatcatcaagtacgggtttccaatcggtcatgcatcacaagatatctcgatcggagagcatattcatgtccataatacgaaaaccaacctgtctgatatccaatcatacagctatacaccaagatttgatgaaaatccgtatactaatgagaaccggacgtttaaaggttttagaagagaaaacggagatgcgggtgtacggaatgaattgtggattgtcccaactgtcggctgtgtcaatggaatagcagaaaaaatgctgcagcgttttgtcagagaaacaggggatatcgctccatttgataacgtactggtgttaaagcatcaatacggatgctcgcagcttggcgatgatcacgaaaatacgaagcaaatcctgctgaatgccattcgccatccaaatgccggcggcgtcttggtgttagggcttggctgtgaaaacaatgagctggcaagaatgaaggaagcactgcaagatgtgaacttgaagcgggtgaagtttctggaatcccagtcggtgaccgacgaaatggaggcaggcgttgctttgctgaaggaaattcatgaagcggccaaaggagataagagagaagacattccgctgtctgaactgaagatcgggctgaaatgcggaggttcggacggtttttccggcataaccgcaaacccgctgctaggccgtttttcagattatctcattgcacagggagggagcacggtgctgacggaagtaccggaaatgttcggcgcagaaaccatcctgatgcagcgggctgccaatgaagaagtgtttcataagatagtccaattaatcaatgattttaaacaatattttatcaaacatgatcagccggtgtacgaaaatccttcaccgggcaacaaagcgggcggcatttctacacttgaggataaatcgctgggctgtacgcaaaaagcggggatttctcctgtcacggatgtcttgaaatacggggaagtgctcaagacaagagggctgacgcttttgagcgcgccaggcaatgatttgatcgcctcctccgcattggcggcggccggctgccaaattgtcctctttacaacggggagaggcacgccgtttggcacctttgtcccgacggtgaaagtagcgacaaacaccgagctgtatgaagggaagccgcattggattgattttaacgcaggccttttagcagaggatgatgttcatgaggaatatgtgctgcgtgagtttatccactatatggttgaggtggcaagcggccagcttgtgaaccatgaaaaaaatgatttcagagaactcgccatttttaaatcgggtgtgacgctataataagaaaaggctatccttcaagcggatagccttcttcattaaatcaattttaaaccgctgactaaaataatggacgccataataaattgcagtggacgcgggagaatcgaggcgaaagatggcttccgatcagcacgccgggaattgaaccaatgagcagattagctgccagcatgtaatccacgcttccgaagctagcgttcaaaatgcctgctgccgtaacaagaagaaatgcatgcgcgatatctgttccgacaatctgtgacgctttcatgttaaataagtaaatcatggcgattgcaaataatgagccggaaccgattgatgttaagccgacgataaacccaaacacaacaccaataagaatcgtcagcgcccgcttattttcaagcggcatcagctgccagcggttgggacgaagttttctatccaaaaacaaacgaacgatgattgaaatggcaaccagcgttaacacatatcctagagcgtgcttaataatttcttcctgatgctggtgaaaggcggggaacaaatgcaagatgccaatggctagcgaagcactcggaatactgccgatggctaagtattttaccaatttaaaattaatcgttttctgccgccaatgggaggcaacgccaaacagctttgtgatcgagttatatacaagatctgtaccgaccgcgatggaaggattaattccaagcacaattaaaaggggagttaataaggccgctccacccactcccgtcaatccgactaaggctccgacaaacaaacccatcaatatgatgcttacactcatgataaaggcctcctgaaaacccgactatttttatcagattatatatgattaggacgcgttaatcaattaaattttttgaatttttgcacgttagctgcttgaaattttggtatgctcaatatctctattcatttgccctataatgagtgtctggacgaaatcgagaagtactaaaggcgcaaaaaaaaagatacctcttaacaggtatcttttttcttgtttacgctacatgcgctgctgatagaaaggaagctcagtgtggcccatttcacgcacataaacgaacaggttgcctttatggtgaatttcatgctccattgcaagctgaagtaacgcgcggcctgtgacttttctgccgaaagcggatgtcagatcaatttctctgtccagctgctcttcagtcagctgttcaaggatagcggccgttttttctgtatatgtttttgccagaacattgagatctgtttctgtttcttcctgcttgttttgaaatggtgaggcattgccttccttaatgacatttgcgaacaagtggaaagacgtaagaatgtgtttgaccagctcttctgctgacattgatgtttctgccggtttgtagctgtaatggtctttgctgattttttcggcaagctcattggtcacgtttcgatgggataaaaaatggctgacaatttgattggattggctcattatgttctcctccatatgtaaaaataaatggtgcaatgaaatcctatatcaacggttacgaattcacaagtaatatgctgtgggatgaaacaaaatgctatgtcaatcgtatatataacgttcacaaaacatgaaatggagtataaacatgactaacatacctttcatttatcagtacgaagaaaaagagaatgaaagagctgcggcgggctacggcactttcggttaccttatcacacggattgaagaaacgctttatgatcaatacggtgtattctatgagctctatgccagtgatgatccaaatacggaatactgggagcttcttgtagaagatgtccgcagcggttcattggagcctgagcatgtggcatatatatttgaaaagcttgaaaagaaaacctttgcttacgatgaagatgagaaagaaccggattataccgtccataagtctataagaaacagtgtatacgcgtatcccgaaaagggagttgcttttgccagaattccatattttcaagatgggagcattatgagttttgattgtctgtttgcggttaacgatgaaaagatgcgtgcatttctggagggagtcagaccgcgtctttgggaaaaaagcaagcggaaagtgaccgtgtttacggatggagatggagggacttcaagagagcaggaagccattgtcagagaggttcagcggagtcaagtcatcatgaatccgctattgaaaaaggagatatacagatcaattgatcagttttttcatagtgataaatcgttttatcaaacatatgacatcccttacaagcgcggcattctgttatatggacctcctggaaacggaaagacgacgttagtgaagtcgatcgcaggcagtatcgatgcacctgttgcttattggcaaattactgaatttacgtcgagcgagacaatagaagaagtctttcaggcagcgagacgcctcgctcctgcagttctggtcatcgaggatatagattcgatgccggaagatgtgcggtccttttttctcaatacgctggacggcgcgacatcaaaagaggggctatttctcatcggtacgacaaactatcccgaagagatcgatccaggtttgatgaatcgtgcagggcgatttgaccgtgcctatgaaatcgggcttccggatgaagagctgcggctggaatatatgaaaatgagaggctttggcatctttttgagtgaaggagaaataaaaaacgccgcaaaacttacagaaggcttttcctttgcacagctgggagaattatatgtatcttcagcccttcaatggcaccaagaagggaatcaccatattgaaaccatggtgaaagacatgacaggagagcaaagaaaaagccagcggggaagctggatggaaagaaacaaagtcggttttcactaaaagaaagcacgggtgtttgaaaaacccgtgcttttttgttgcggttagccgaaattcgacaattgcggttattttgcgttcttctttttcttgtaaatatgataaaatatgacatatctcgggtaattcaaaagggggattaattgaggatgaagcagacgattccgtcctcttatgtcgggcttaaaattaatgaatggtatactcatatccggcagttccacgtcgctgaagccgaacgggtcaagctcgaagtagaaagagaaattgaggatatggaagaagaccaagatttgctgctgtattattctttaatggagttcaggcatcgtgtcatgctggattacattaagccttttggagaggacacgtcgcagctagagttttcagaattattagaagacatcgaagggaatcagtacaagctgacagggcttctcgaatattactttaatttttttcgaggaatgtatgaatttaagcagaagatgtttgtcagtgccatgatgtattataaacgggcagaaaagaatcttgccctcgtctcggatgatattgagaaagccgagtttgcttttaaaatggctgagattttttacaatttaaaacaaacctatgtttcgatgagctacgccgttcaggcattagaaacataccaaatgtatgaaacatacaccgtccgcagaatccaatgtgaattcgttattgcaggtaattatgatgatatgcagtatccagaaagagcattgccccacttagaactggctttagatcttgcaaagaaagaaggcaatccccgcctgatcagttccgccctgtataatctcggaaactgctatgagaaaatgggtgaactgcaaaaggcagccgaatactttgagaaatctgtttctatttgcaagtcggaaaagttcgataatcttccgcattctatctactctttaacacaagttctgtataaacaaaaaaatgacgccgaagcgcaaaaaaagtatcgtgaaggattggaaatcgcccgtcaatacagtgatgaattatttgtggagctttttcaatttttacatgcgttatacggaaaaaacattgacacagaatcggtctcacacacctttcaatttcttgaagaacatatgctgtatccttatattgaagagctggcgcatgatgctgcccaattctatatagaaaacggacagcccgaaaaagcactttcattttatgagaaaatggtgcacgcacaaaaacaaatccagagaggagattgtttatatgaaatctaaatggatgtcaggtttgttgctcgttgcggtcgggttcagctttactcaggtgatggttcatgcaggtgaaacagcaaacacagaagggaaaacatttcatattgcggcacgcaatcaaacatgatgcataaaaaaagacccttaggggtcttttttatttcttcagcttccattcttttatcgtcagctcagaagatccacttgccaccagcggatccgcatggccgatttccgctgcctcttccagtgaatctgcttcgatgacatacgctccgcctgtggcgtcgctgaatggcccaaacatttttaaacgtttttctgcttgtaaacgatccagaaattcatagtgcccagccacatgctcctgattaaatttctccgttctcattgtcagcattaaatatgtatacatattcagaccctccgtgaacttcagtttaacacatttatccatattacggtgatagatgatatgagcttttcgtcctacgaatgccacctatttatgaaaaaagaaaaggagagatgataggtgagcattccagtaaagaaaaatttggtttctgaggcgaaatacgcgttgaagtgtcctaatgcaatgtccgctgaatacattaccattcacaacacggcaaacgatgcatcagcggccaatgaaatcagctatatgatcgggaacacaagctcgacaagctttcattttgcggtcgatgatcaagaggtgattcaaggtctgccgcttaaccgaaacgcctggcacacaggtgacggcacaaacggtccgggaaaccgcaaatcaatcggtgttgagatttgctacagcaaatcgggaggcccgaagtatgaggcagctgaagccttggcgatttcatttgttgcacagcttttgaaggagcgcggttggggcatcgatcgtgtgagaaagcaccaggactggaacggaaagtattgcccgcaccgcattttatcagaggggcgctgggatcaagtgaaggcggcaattgaaaaggaattaaacggggcttatcagctaaaaaagctgcagtctcttcttcagcgtctgtatatcaggtgaaaaaaggcgacacattgtcagggattgccgcatcacacggagtcagtgtgaaaacgctgcaaagcatcaatcatattactgacccgaattacattaaagtcggacaagtgatcaaactgcctcagacggcatctgcttctaaaagccatgccgcatcctcatatccgctcccatccggcgtgatcaaagtgacaagcccgctgacgaaagggacaaaagtaaagcaggtgcagaccgctttagccgctctttatttttatcctgataaaggagcgaaaaatcacggcgttgacggcgtttatggcccgaaaacagcaaatgcagtgaaacgttttcagtctgtcagcggtttaacggctgatgggatttacggtccgaaaacgaaagcgaagctggaggaaaagctgtaaatgaaaagacggaagctgtgaagcttccgtctttttatcttacatacaaactgcggcaagcaccttttgaatatcataaatgctctcatcttttttaaactgctttgagacggcaggaagttctgcgccggagatccaaattttcagctctgaatcgagatcaaagcggccggccgtttccacgctgaatctggaaatgcttttgtacggaatcgattgaaactccgttttcttgcctgtgattccctgcttgtccacaagaataagccgcttgtcagtgaagacaatcaaatcgcgaaccagcttaaacgcggcttcaaccttctcaccctcaagtaaaatatgagcaagctcttcttttacagcagccgttgacagtgttgacgcattgccgagtaatccatcaataaaccccatcatatacctcctctgcgtattctatcaaatcatactataaaaagggttttcattcatggatgagtagagtaaactggtgctgactggtaaagggggcgttcaaaatgacagataggtatgacagctttgcagccctttctgcttctgagtcggaataccggattatttatgaggaaaaaaacggaagtgaatttatcgtcctcggtccccacggcggcagaattgagcctggcgtcagtgaattggtacgggcattttcggatcgatgctccatctatttgtttgagggtgtaaaacagcgaaacaatcgttccttgcatctcaccagcattcgttttgatgagccgctggctttagaaaaagtaaatgaccaccattacgcattagcgtttcacgggtattatgatccaaacatcccgcatactttggtcggcggggctgatcgaaaaaaagccaagctcatttgtgagcgtctgaatgaagcgggttttagcgccgagctaactaatgagaaagaccgcctggcaggtgtacacccaagcaatattgtcaatcggacgaaaagagaaatggggctgcaattggaggtgagcacggcacaaagaaacgcgctgttctgcaattttgggtgccgtgataaaagctacatacaaaacgacttgtttgatcgatatgtggaagccgtcaagcttggcttttatacataaaacgaaacgggacctgcactgtcagcctattccttcatacgctgggattgtgcgaaagtgtagggaggaatgattcatgttttatcatataaaagagcttcaatatcaagcaaagccagctcatcccgatccggtttatgcgaaaaaacttcaagaggtgctcggcggccaattcggtgaaattagcgtcatgatgcagtatttgtttcaagggtttaactgcagggcggatgctaagtataaagatttgttatatgatgtgggtaccgaagagatcgggcacgtagaaatgctggcaacgatgatttccaggcttctggacaatgcacccgcggatgtacaggaggatgcttataaaagcaatcctgctatcgcagcagtcatgtcagggatgaatcctcagcacgcgattgtgtccggattgggggcgatggcatcagatagtgagggctatccgtggaatgcaaaatacattatctcaagcggaaacctgctggccgattttcgcgctaacttaaatgcggaggcccaaggacgccttcaggtgacacggctttatgccatgaccgatgatccaggggtaagagatatgctgtcatttttgattgcaagggatacctatcatcaaaatatgtggtacgcggccattaaagagctggaggaaagagaacgggatattgtcgtcccgacgacgtttccacgtgagctcgaaaagcaagaagtctcctatgatttgtttaacttttccaggggggatgaaagctcgcaaggaagatgggcacatggggaagcctttgacggccggggtgaattcaggtatatcccggctccgattgcgttcgcatctgcgcctcatcttaaaccggcgcccatgtggctgcataatacagttcccccaatgtcgaaatgttaggttctcttctgggctgaggaatatatccttagcccgtatttgatcagatgtttttgccaatatgatataacgctttttcctcagcgacctgcaagtgctgctgatcgccttcctcgtacgcatgtggccgcttgtgagataataaataagcgagccgcttctgaaattgaatacctgctttacgccgttcaaacatgtcaagccttttatcagcaaattcctttgttacccggaataccgccgcaattgtggcgagtgcctggcttctccattgcggcagttccatctgcaacagcataaaggttggcacacagaagtggtacataaattgatttgcctggaattcttgaagctctctgaagagcttgttcatctgaaaatgattgcctgcatgctttaacacgtggcacagctcatggccaaaatcctcccattgctcttcccgtgactttttttggttcaatacgatactgtacatgccgtcgtatttcaccatcatgctccccatatcctcaaaatgcacccaaatatccagatcctttgcgattttcagcatgtcaatgtgatgaggggatgtgatgcccagccggccgtataaatttttaacgtattcctccagatgtgataagtaatcgcccaattgaatactccctttcgaacgtttgttctgtttttagcgagaaagaaaagcccgtataggactggaaagtagtgtagaaatctttcccttttctttaaaaaataaacacttttttctttatatcggtctactttttatatgttttagagaacagagaacgatttatttatttttcggtttgcggtttttctctttttcttttaaatagttgataaattcgatggcctgctgtttgctttctggggaaaaatcctgcatatcgcggtatgcaagctgcaggtccggatctgagaacatatcgtcatcggattttttgtcttttcccgttaataagtaatcagtcgttacttgaaagtaatcagccagcttttggagtgtgtcgtaatcaggttcgcttcgcccattttcatagtgggaatatcgtgcccgtgacacaccgatgtgtgatgcgatttcttcctgtgtccttttccctctgagactcttcaatctgccgcctatcatactatgacctctcttttttaaactccctacgttacttatgattatagatacaatatgtatcaaaataaagttatgataaaaaaagtatcaaaaataacttgatgatacagttcgtatcgtttatacttggtaacagttgatacgaaatgtatcgaaaacaaaccaggagagtgatcacatgtatccaatccaaattgtttttagtgaaaatcccatagatcagcgccatctcggacaatccggcggcaccatttcgtttacggcatgcggccttccggtgttccactttgaaacgcaagagcagtttcaagcatacatgatgttaaagggagaagcggcgtacaatgaaaaacgataaaagctatccttttccgacgtattcagggttattgaattcagaacattatgacaaaattggcccggcgctatggttgtttctctggtttatcagctcaacaacaaaagaaatcgaaaaagacggggtaagctggggcatcgtactcggccataagccgttaaaagcgagagaaatggcggcagtcttcggcgtaagtgaaaaaaccgtcagaagatggctggagcttctcgaaaaccatgattacataaaggccgtccgtgcgccatacggactgatgatttcggtcaagcattccaaaaaattcagcttcagatcggacaatactgtacacgggtgtctaaaagaacggccattttcgccgcagacaccggacacaaacgaccgtacagatatagataaaacaaacaaatatactgctgctgatgatgcagtggatcacattgcgaagcggtttacacaattacggtcggctcaagaaggacgcaccgtgtatccttcctcaagagattatcaagccatcgcccgcattgttgccatcggcgttcctgtcacgcaaacaatcaaatggcttgaagaatgctttcaggcttttgaaaaccggcggaccgccgcttctgaaacaatcaaggcttttcgctactgctcgaaattcattgaagatcgatttttcgcgcagcaagccaaaaagaatgccgcaattcagcatgagaggatgaaaaaacatgacaaaacgaacaatcgaacagattttggacgagctgagaagagggagacgtccattactggcggacaaaccggccgaatcagacgcaagcaggtatgattgcctgcgctgcaaggatcagggaggttatctcgtcaggcagaatggcctggaagtctggacgatgtgcagctgcatggcagaacggaaagtgaagcggctgctgggtgcaagtgagattacccacgctttcagacagctcggcttcaaggaattccgcacggagggaaagccgcaggccataaaagacgcatttgagtgtacaaaagagtatgttgccgattatgaacaaatcaaggattgccgaaaaaacagcattgcccttttaggacagcccggatcagggaaaacacaccttttgactgccgctgccaacgaattaatgaaaacatgctatgtgcctgtcatttattttccgttcgtggaaggctttactgatctgaaaaatgattttgccctattagaagtgaagctgaaccggatgaagcaggcggatgtgctgttcatagatgacctgtttaaaccggttaacggcaaaccccgcgctacagattggcaattagagcaaatgtattcggtactcaattatcgctacttaaatcataaaccgattttgctttcgagcgagctgacaattgaaggacttgtacgggtcgatgaagcgctcggcacgagaatctatgagatgtgcagtgactatttagtgattatcaaaggagcagcctacgagcttaaccatagattggagggcgtcagataatgtgtaagctttgtcaaacaaagaaagtcattgtggaacataccggtattggagtcgttttttatccatgtccgaactgccggtccggcactgacttaacgcctgtcattcaaaagctggagcaaatgctgacagcgggaaaagcgaggctgaatatctatgattaaacagctgactgcactaatcgctttgctgtttcgggcaaagcgaacagaaaaaaacattgaacaatggtataaggacgacgggaagtaaaagtgttggcaaagacaaaacaggcagagaaaagccctgcgccgtggcgtgctgtcccgtgcggggatacgaaaccgatctatatttattcagcttacagtgaagaagaaaaagaaagattcccatattcaaacggacggctgattgccgctgtatttgacctcagctcttattcgcaaaaaagcaatgccgctttgatggccgctgcgcctgaattgctggaagcgtctaaagcagctcttgattttctgaagggaaattctgttcattcaaaggagcgcatcattcagttattagaaaaagctgaagcaagcgctgcaccgaaaaggggaggaaataaaacatgattcatcctaaaaaactgcagcatattgattccgtcacgcttaagagccagctggaggacgggaaaatccgtgtcattattgtggatggcatcaagcaagaagcatggatcacagaagcgcccgagcatggaaaaacgctcgtcgaaacaagaaagggcgatcttgcccgtgtggaatttgaaatcggctacaaattaaattaaagcgaaaacagaatacgtccaagacggaaagcctgcggacactgatcaactgcacagcatttgtgcgttgattggtgtccgttttttatttgccaaaaataaggaggatcatagaatgcaagacttactatttgaatataaacgcacgctcaaacaaacaagaatacaatataaaccgctcgctgaggcagatgaatccgtgctctcagctgaagagctgaaggataaaaaaatcatcagaaatatgattactgatcttgaatatgtaacagaatggcttgaaaaaggaaggcagcccggcatcagacgggcgattgaccggcgtgatgcctaccagcggctgatgatcaaagacccgagaatcatcgaatcattttccagcgctatgatgtttgagccggacggacaggtatcagaagaagacagagagagaattcgagaagcattagccctgttaacggacagagaaaaggaaatgtttttgctgcataaggtagaatgtttttcttatgaacggatcgccgatcttctcggcgtaaaaaaatcgacagtgcaaacgacgattaaacgggcgagtttaaagatgcaaagacagcagaaagaaatgaatcgatcacttgcctgaaagcttgtcatacgtttgccacctataagtgaatagagcatgacacataagcggctggcatgatcagccgcttttatgaataaacaaccatgctggaggtggcggtgatgccgtagcatgaaaacacaacagcgcgaacaagcattagcaatctatcaacatcatcaaggaaagatcacaaatcgggcgattgcggacacaatcggtgtttccgcgaaaacaatcggcatctggaaaaaacaagacaaatggaaagaggccctgttttctgcgtccaaaaacgaacaaaaacagcgccctatagacaacgatgaattaaatgaacgccagcggctgttttgcctgtattacgtcaaaagcttcaatgccacacagtcagcaatcaaagcgggctattctccggacagcgctcatgtgacgggcagccggctcttaaaaaacgaaaaggttgctgctgaaatcaaacgcattaaaaaagaaatggtcaatgagatgtttattgaagcgatggatgtgctgcaggtttatatcaagatcgcgtttgcggatattacggactatgtgacctttggaaaaaaagaggtccaggctgtcgggaaatcgggtccgctgtttgatgaagatgataacccgattatgaaggaagtcagctttgtcgatgtcaaagactcggggctcgttgacggcaccattgtaacggaagcaaagcttggcaaagaaggcattgccatcaagcttgcagataaaatgaaggcgcttgagaagctgtccttatattttgatttgtttccagatcaatttaaacaaaaaattgaaaatgagaaattgaagcttgccaaacaaaaagcggagaaaacagatgacagccaggagccgattgaaattatgatcaaacgaaaagagggcaagtcatgattgtaaaagaaatcaaccctcatttcgaagattacgtgttcaattgggagcagacgtaccaatttctcgtcggcggctacggctcctccaaaagctatcataccgcattgaaaatcgtgctaaagctgctgaaggaaaaacggacggcccttgtgatccgggaggtgttcgatacccatcgggattcgaccttcgccttgtttcaagaggtgatcgaagagctcggtctcacaaaggctgtggcatctctttcttccccgctgcagctgcgatttcacaatggcagccggatcatgttcaaaggaatggacaatccggcaaaattaaaatcggttcataacatttcattaatatggattgaagagtgctcagaggtgaagtatgaggggttcaaggaattaatcggacgtcttcgccatcctgagctgaagcttcatatgatctgtaccaccaatcccgtcggcacctccaattggacgtataggcatttttttcgggatgaacgcaagaaacggtttgtgctggatgacagcgaactttacgaaaagcggacaattgtgaagggagatacgtattaccatcattccaccgctaacgacaatctttttctcccggaaagctatctgaaacagcttgacggactcaaagagtatgatcctgacctgtaccggattgcccgcaaaggacgattcggcgtcaacgggatcagggtgctgccgcagttcgaggtactcccgcatgatcaagtgaaaaaatgtatcgcagccatcagcaagccaatctttcgtacaggcatggattttggattcgaggaatcctataatgccgtcgtccggcttgctgtagatcctgagaaaaaatacctctacatttattgggagtattatcaaaacaaaatgacagatgacaggacggctgaggagctgcgtgagtttattgagacacaggaattgatcaaagccgactcggctgagccgaaaagcattcaatatttccgccagcagggctttcggatggttggagccagaaagtttcccggctccaggcttcaatataccaaaaaggtaaaacggttcaaaaaaatcttctgttcggatcgctgtgaaaatgtcatctatgagctcaagacacttacgtatgccaaagataaaaacggagctctgattgaggatgaattcacgattgacccgcatacgctttctgccatttggtatgcgcttgatgattatgaggttgctgatatgaaagagacagcacacaaacgaatccggccgaaccgagaaaggaggaggtcataaatcatgcacaatcaaacagtcagagcaactgtatttaaagccaatgccgcggctcctcagacaaagcaaatctatgaagatgacttttctgagctgtacggagaggacattatcgctccgccctacaatatcatcgagctcaaaaccattgccgaatactcgactattcttcagcaatgcattgatgcgtacagagtgaatattacaggctttggattcgatgttgagtacacatttgatgtcaacgcaagtgatgtcgatcaggcaaaaaagaaaagagcggaaaaagactgggccagactcgaagccttttataaatgtcttcactttgatgaatcagctgaaatgattttaggctatgccatcgaagacagagaaaaaacaggcaacggatttatggaagtgcttcgcgacggggcgggaaaacctgccggcatcgaatatttagatgtgaaatatatgcgtgtatgcggagccggcgagcctgtagaggtttcatttgtatatgaagaaaacgggaaaatgaaaaggatcaaaaggcaaaaacgcttccgaaaatatgtgcagatgatcaatggaaagaaagtgttttttaaagaatacggcgatccgcgaaaaatggatatgcgcacaggtgaatatgtaaacacattggcagagaagtatcaagcaaatgaagccattcacctcaaaatcggaagcggcgtatacggtgtaccccgctggatcggcaatattgtcaatttatacggggcccgaaaagcagaagagctcaattttatgtattttaagcagggacgtcacgtccccgctgcgattacagtggaaaacgggatgctgtctgaagcttcttaccgggagctgcaggaatacatgaatgatcttgaaggtgttgaaaacgcccataaatttctcctgatcgaagcggaaggaatcgcaaaagaaaaggatctccacggaggcgaggatattacgccggtttccgtggaaatcaaatccttggctgaaattctccaaaacgacgccctgtttcttgaatacgatgaaaaaagcagaaataagctgcgttccgcgttccgtctcccgccgctgtatacaggcgaggcccaggaatacaaccgggcgacagctgatactgctagaaaaattacggaggagcaggtttttcagccggagcgaaaaacgctcgtgaataaactgaatacgctgcttttgccggagctgaatatccatgacgtcaggctgacattaaaaggaccagactttcgtgatccgcttgagattgcaaaggtgctcggtccttttattacagcaggagcagtctcgccgaatgatttacgcgaccttgccggacgggtgcttggcaaaacactggaggagtggccggaggacatttataaacggcctgcaggacaggatgcggaaaagacaaacctgactgcgctcatgcaggagttgaaagaaagcatcgaagatatcaaaacgtcctgaagggaggtgaatcaagcaggtggcgcgagaattaagaaatgccaaaatcagctttgtcagttatgtggacaaggcggctaaccagacagaatttttctttacgaagtcagccgcacctccgtcatttgaaaaaaaggttcggctgtttacaaaaagtgagcaggatgaacaaaagctcgtgtacggaatcgtgtatgagcctgatgttcctgatgcccacggcgattttatgaccgccgaggaaattgaaaaagcggcgcacggttttctcgcggaggcacgggagattgatatcaatcacagctttgagggcggaaccggcgtcgtggtcgagtcctatgtggcgcccgatgattttatgatcgggtcaaagcggattacaaagggctcatgggtacttgtgacaagagcgtctgacgaggtgtgggaacagattaaggctggaattatcaccggctacagcatggctggcactgcagatgtgtatgaagaagaaccggtcgaaaaagcagggttctttagtgtattcaagcaaatgcttgctgacaaaacagggaaggagactgaagaaatgagaaaagaagacatgaaagaatcattcgagcatgcgctttaccctctgctcaaacggcttgagcggattgaaaaaaacacagacacggaggaaaagccggagcagacgggtgatgacgagcgtctgaaaaagctcgttgaagacatgcttgccccgctgatcgaacgcatcgaggctttggaaaaagcgcgaggcgcgtctaagcagacagcggacgatacgggcggcaatacagagcaagtcaaaaaatcaatctggagcggactgctgtaaaaccagtcaaggaggaggaaatcaattgagaaatcaagagatcattcggaaagcggaaatgtcgctttctgctttaaaaagcggcgggcttatgaaccctgcgcaagcatcggcttttatccgcatggtgcaaaacacgccgaccattttcagtgaatcccgcgtgattcaaatggaaaatgactcgcaaaaatttgagaaaatcggcttcggccagcgtattctgcgggctgcgcaagaaggaaaagcactgtcaaacgacgagctgacagttccaacgacaagcactgtccagctgaacacgaaggaagtcattgcggaaattaacattacgtatgacacacttgaaaacaatattgaaaaagacggcctgcagcagacaatcatgcaaattttagcagagcgcgcagcagttgatattgaagagctgatcgttaacggtgatacagcatcagctgatccgtatctggcacagctggacggcatccgtaaacaggcggtttcccatatcgttgacatgaacggtgaagaactgtccagagcgacattcaagaaaggcttaaaggcagttccgccaaaatatttgcgcatccctcaggaattcagattctatacgtctcacggcttagaagttgaatggaaggaccgcgtggcagaccgccagacaaaccttggggaccaggctgttcagggcggcttgtcaacagcattcggcgtaccggtcaaaggagtatccaatattcagccgtacacagtcggtgagggagacgcgcaatatgacgcttctgatatcattctcacacatccgaaaaatatcattctcggcttctcccgcaatatccgaattgaagtcgacaaagacatccgctcccgtaaattcattattgtcttaacggccaagctggacagcaagttcgaggaagaggatgcctgcgcgaaattaattaacgtaaaagaataatagaaacgaggtggtcagctcatgctcattgaaccgactgacgtagcctcctattcggtctatgatcgggtgaaaaacaggccggaagagctgctggcgcaggatatcatcgaggcggaagcagaagcggctctcatcacgggccaccgctttgaagacagcttgtatgatccgctgcccggtaaggtgaagttggctttagtaaagcttgcccagtattttgcgcttgtcaacagcgatgaatctgcctcatcaagctatcagtctgagaaaatgggggattattcctacacggtttccggagaaggcgggattcagcggcctgaggtgtatcatttgctcgaagagtttatcaagccgggctacgtccctgaatcctccagactgaaggtgagatctttatgagctacaagcagatgctcattcaccgttgcgacatttatcatgaagcagcccaagcgccgtctgcaggccgatttgggattccggcagacaggctgcagccggtgatttcatatcccgatacacccgatgaacaagatgtcccttgttattttaccgaaaaaacacagcagctggttcaggaggagccggatcaaactgtatatcacagctttctcgtccattttccgttgtcagcggatatccgcgtgaacgataaaatcatttgggagaatcataaatatatactaaagctgccgataaggatcagacatcatcattgggaggtcgtcgcagtcagggatgaaagcctatgaaaatagcgggattgaaacagctgaacacggcattaaaagaagcggcttcaggcggtttttccagacaggcgtcccagtggcttgaggagtgcgggcaagattttctggagatcgtccaatctgaactcatcagcacacaaacgattgatacagaaaaactgctcagttcctttgagaaaggcgcagaggacaatctctggattgtgcaaagcggcgggctttcgcttgaggtgggaacacagcttgattacgcctcatttcttaatgacggccattggacgtcaaaacaagatgtgagatgggtgccggggcgttttcaaggctcacggtttatttatgatccagctgcttcaacgggaatggcgctcaagagaaaatggataccgggcacgggctactgggatcatgcactgcttttatatgaacagctgtttggaaaatcgctggaaagcaaactgcgccagtggctgaagaagctgtaaaggaggagcaggatgaacagtgaaacaggatcgatcatggcgtttttgtacagccggtggtctgttcccatttatgaacgcgagcttcctgatcactttcaggtgccgtcgttatacgtcccgccaccatctgttttcgaggaaacagatacggtctccacatttaaaaaaacctacagtctcaatgtaaaactgtttcatctggactccgttcaggcactggatgaagcggacaggctcgcggatgccatcagagaagcgagaaatatgattccgctgctgagtgaatccggtgagaagacgggggatatggttcgcatctcccaaatcgagacaagggtaggggacaggggcgaggcggccatggtgatcaggtggagcagccgatattattatcacaaaacagaacagcctgtcttacaggatatcgacatgaacagcggggtgaaataaacggtgtcaaaggacaaacaacagaagaaggctgtacatacaaagagccgagaagctctatttgatacagcggatttgattaagcatgcgaaggaactgttcggcgttaagccggatattcttcagggggctttatttggcgtggatcaaccacgtatgacgaaatcagaagccaaccaattgattcaaacatttctaaccaaggaggtcatgtcatcatgaatggcggaacatttacaacaggcaaagaaaaagaacgtgcaggcatttattttaactttaaaacgacggcacaggagcgggtatcactcagtgaacggggaacagtcgcacttccggtcgcatcaagctggggcgaagcgaaaacgttcgtctccatttccagcgttgaagacctaaacaaaaagtgggcctcagcattgatgacccgtctttattgctgctgcgtgaagcgaagaaaaatgcgaaaacggtattgatgtaccgtctaaccgaaggtgtccgagcgtctgctgatattgctgaaggcgtcaaagcaactgcagtatatggcggaacaaaaggaaatgacattatcatccgcatcaatcaaaatgtgctggatgctaattctttcgatgtgacaacatatatggacgaatcagaggttgataaacagactgtcaaaaaggctgaagaattaacagctaacggctatgtcacttttaccggaacaggcgatctttcttcaacgattcctctcactggatcagaaggagacactgcagctgagacgctgaatgcatccgcgggcatccgtttatctggcggtacggataaagcccctgtcaactccgactatacagatttcttagccgcggctgaaacggagagctttgatgtgattgcgctgcctgttgcagaaggtgaccagttgaaggcgacgtttgctgctttcattaaacgcctgcgcgacggccaaggacaaaaagtgcaaggcgtcacagccaattatgccggtgattatgaaggcatcatcaacgtaacagagggtgtgctgcttgaagatggcacggaagttactccggacaaagcaacagcttgggtagctggagcgagtgcaggagcaacctttaaccaatcactcacatttgtagagtacgaaggcgccgttgatgtgttacaccgccttgaccacgatacgattgttgaacgtctaggcaaaggtgaatttttattcacattcgacgcccgtgacaaatccgtcagcgtagaaaaggacattaactcactcgtgacgttcacagctgagaaaaacaagaaatttgcaaagaacaaaatcgttcgtgtcctggatgctgtgaataatgatttaacacgcgagctgaaagccttaattaaatcaagaaaaggcagcggaagcgatatcccggcatctgaagacggactgcagtatgtaaaaacgatgatcacgcaatacatgacaacgcttcaggatgcgggcggcatcactggctttgattccgatgaagatatcacaatttcaatgaatgaagatcgtgacggcttcttgattgacctggctgttcagcctgtcgacgcagcagaaaaattctactttaatgtggaggtaaactaatatggcattaaaagcacaaaacacaatttcaggaaaagaaggccgcttatttctcgatggtgaggaaatggcgcacatcaaaacatttgaagcaaacgttgagaaaaacaaatccgaagtcaacattatgggccgccgcatgacaggccataaaacaacaggggcaaatggaacagggaccgcaacgttctacaaagtcacatcaaaattcgtgctattgatgatggactatgtcaaaaaaggcagcgacccttatttcacgctccaagctgtgctggatgatcaatcctccggccggggcacagagcgagtcacgctgtacgacgtcaactttgactctgccaaaattgcaagccttgatgtcgattcagaagcgttagaggaagaagttccatttacattcgaagacttcgacgtccctgaaaagctatctgacacgttttaatcaaagctgaatcagcccatacgcagacctttctcagaaaggtctgtttttaaaagatgaaaccaaacaatagacaagggagttttttacatgagcgagaagaacgaaaacgtatatgatctttccttttttatgccgggaaaaacaattgaagctgaggaaatcaaagtgccgatctcaaagcgttttgttgataaaaaagggaatgtcattccgtttattttaaaaccgattactactgaacgtattgatgaattagagaaagaaaacaccacatttaaaaatgtgaaaggccgcggccgtgtcaaagatttagactcccagcgcttttatgcgagaattgccatcgaatctactatttatcctgattttcgttcaaaagatttaagggaagcatacaaaactgcggatccggtagaagttgccaaacgtgtattatctgttggggagagtatgcgaactggctgaataaagcaattgaaatcaatggttttgaagatgatcttgaagatctagaagaagaagcaaaaaactagtaaaggatggcgataaggaagctgtgtatttgtactatgcaatgcatgagcttcattactcgccatcccaacttcttgaattatatgaagcaccaaaacattttaaagctcttttatttgggttgataggttataagctagatctattagaaaaagaatcaaggagaggagggaactaatatcgcaaaattaacagcccgttttgatctcgaagacaaggtatctaaaaaactaaaacggatacataaaggattccaagaggtcgaaaaaaaagtcaaaaccattaatcggcaaatcaaaatcagtatcagagcggaagatcaggcattttaccggctgagaaaaataaacgactatatcattttgaaattcgcgaaatcgcttgaaattaaagttgtacttgatgaccaagtcacttcaaagcttgatgcaattgaaagaaaacttaaacggctgccgaaagaaacgaagctgactgtctctttggtagaccggacagcagctgcgtataaaaaaataaagaagatgctttctaatcaaaagctatcattccttttgattccagatgacaaggttacttctacagttaaaaggattatcggttatattaagaaaaatttgaaaaacggatacacagtcaaactaaaggtcatcgatgaaatcaccaaaacagttaatcgattaacagcacttctcaggaaatttgaaaaaacctattatgtaaaagtggttgttaaaacaaaagtatcagataaaatcaataaaaaagaaagcccgattaacaaagaaacttctaagagagaatcagacaaatcctcagataaaggctctgataagagctcagatcaaaaacctggttgggtcggaaaaataaaaggttggctgaaggattggtggacaaaatcagcttggccttggatcaaagatacgctcaatgaaataggcaaagcttttttggatcgtttcaaagagagattgatagaaaagctgaaaaatgatgtgtttgataagatcattgataaaattctaggaccacaaaaaaaggacgattctggtgaaaattctgacacagataaaaaagtccttaaccgtaatacaggaggaaattgttgctgtgactgctgtgaaggcggtatcagcccgggcactaaaaataaaaaaacctatagaaaaaagaaaagccccacaaaggctccaaacagaacactcaaggttcctggagaggtgataagaagacgccagagcggcacacctgctgaaagtgcacctaggacctcgggttccaagttaaagaactggcttggagggttaaaatcgctagggaaagattcatccaaactaggtaaagcgttcagaggaatgggaaaggctgttccatacgtaggatctgctttagcagtgtttgatttagctggaatcaataaagataatgctggcgaaaaggttggttcaatcggaggacgcattgccggagcggaagctggtgcaacagccggagcggaagctggtgcaacgattggatctttcgttggtccggaaggtacagcaatcggcggggcaatcggcggaattggcggcgaagaagcaggtaagaacattggtaagatgtttgatacttctcaaatcaaagagaacatttcaaatacattatttaatggtgattggtggaatgaaaaatggacaggtgttaaaacaacaacgagtgatactctcggaggccttagtgatacgtggactaatataaaagatacagcttctactaatttttttgactcaaattggtgggctgaaaaagctggttatgcatacggtacattagagtctacgcttttcaatagtgattggtggggcggaaaatgggaatcggtaaaaggttggacacaggaaaaatgggatcaagcttcctctgtatggaactctgttaaatcaaaagtaaaagaaacagtctttaataaagattggtggtccggtaagtgggaaggcgttaagagctgggctcaagaaaaatggaacggtgccgtttctgtttgggaatcaattaagtcgaaagtaaaagaaacagtctttaataaagattggtggtccggtaagtgggaaggtgtcaaaggctggacaaaggaaaaatgggaaaatacaaagtcactttggaaaaaattcaaatctacacttgaggacagcctatttaataaagactggtggtctggaaaatgggattcagtaaaagagtggggaaaaaatatattaggagattcttgggatgctataaagtctacaggcgggaaggtagtaaaaactgctcaaaaattgggcggcggagtgacgtcttgggttaaagaaaaggtagatcattttcaaaaaggacgagagaaggctcacagagacttcgggatgaaagctgacaaaaacgccacaggtggttttattaccaaaccgactatctcctggatcggtgaggcaggtaaggaatttgtcattccagtcgacaacaatcgcggccgcggcaaaatgctgttagcgcaagccgcatcgaaattgggcatgcatgtggtcgatgatatggcatcagcctctacactttcaggtgggacagctctaaacactgttggcagccaatctgcttcaatgccatcttctattaatacatctagccttaacggccaagcttcagacctcggacagcaattttcagagggctttggtaaaggcatcagcaatcagccggtcaaaatggaagactggaaaaagaaaaacatcaatacgccatttacacaaatgatttctgcttcaccaaattacggtaaacaaatggtaagcgggtatgccaagggccaaaacggcactgcaaccggaacggacggctttttgcaatcaaaagttaaaacgccgtaccaagctactgtaaataaatcgtcatcatgggggacaggtacggtcaaaggctttgcgcaaggacaaaactcaacccaaacagggactgcacagtatgtgagtacacatgttgacaaaccgttcctgcgttcaaaagacacatcgaacagctggggctccggtttgatcggaaactttgtgacaggtatgaattctaaatccagtgaagtaaaacaagcagcaaaggatatggccaagagagtggagcaggctttccgtgaggagctagatattcattcaccttcccgtgtcatgatgagcttggggcgttttgcttcaattggtgttgtcaaaggacttggctcagtagatgtaaagaaatatgctgaaaaacaagctggatcactggcggctgcctattccggaatgggagccatgggcgggaacgtaaaacaatggattatggctgctctcatggccaccaagacaccgataagctggcttccggactcatgacgattgcgcagcatgagtccggaggcaatccgaatgcaattaacttgtgggacagcaacgcaaaagcagggcatccgtcacaggggctgatgcagacgatcccaagtacctttaatgatcacaaagcgccgggcatgggtaacattagaaacccgattcacaatgcagctgctgcgatcggctacattaaaagcagatatgggtcaatcaataatgtgccggggattaaaagcttgaatcatggcggtccgtacgttggttatgccaacggcggactgattacgaaagaacaaattgcacgtgtcggtgaaggaaacaagcgggaatggatcattccggaggagcgaggcatccgcggccgctacctccttcagagagctgcgcaagctctgggaatggaagtgacagatccgtctcaatccgagcaatctgagctttcttcaggtcaagtttcagcagttacatccggtacacggcaaacgatacaaacagccggaacgaaagaaataaagattgagtttaacggagaccagcacttccataatggacaggacgctgaaacccttgcagcgaaaataaagcaggcgcttatagatgaactgcaaaaggatatcaatattggaacgaagggagtcgttgcatttgactaaatccgtatatgaattttggatttcacaagggaaggacaagttgcggctccccgttcttcccgaccagctgaatatttcaaatacggttcagaatgagacggttaaagtagccaagttcggtgaccttacatttattgacgaacaaggcgcgaaagaaatttcgttctcttcgttttttccgaagaaatacagcccaatagctgaatatcaaaccttcccgtcgccggaaaatgcgataacaaaaattgaaaaatggatgaaggccaaaaaaccggttcagtttttgattacgggaactaaagtgaatttaacatgcagtattgaaggtttttcctatagcgaaggccagcaggatataggtgatcgcacctttgatattcaattaaaagaatacaaaaccgcttccccgcggaaaatcaagcagaagaaaaaaacaaaggcaaaacgtccgtcgaaggctgcgccgaagacgtacacagtgaaaaagggagacacgctatgggacattgcaggcagattttacgggaacagcactcaatggcgcaaaatttggaacgccaataaaacagcaatgatcaaacgaagcaaacggaacatcaggcagccgggccactggatttttcccggccaaaaattaaagataccgcaatgaaacaggtgatgtatgatgatagaactgttcgtcattaaagacacagagtggcttgagctggttgctgaaagcgtatcgcttgaaggccaccgttatcaggcgccgcgctccattgaagcgaccatcgtcaccaaacagggcgaccagacgtattacagtgtctcagaaggagatacggtcttgtttaaatggaagggaaaagagctgtttcggggcattgtttttgcaagaaccccggacgagcatacgcttgccttcagcgcttatgacatgctgcagtacctggtcaaaaaccaggatatgtacgtgttttccaatcagcgggccgaccagatcatcagaaggattgctagtgacttccagataccgacaacctcgatcgcgaacacaggccatacgatcaaaagtcttgtcattaaaaatgatacgacattgtatgacatcatattaaaagcgctgaaacagacgaaaagccagacaggacgacattaccagctgtattcggaaaaaggaaagctcggtctgcgcgcttggccagatccgtcagaggtatgggtgcttgaaacgggcgtcaatatcacaggctaccaatacagcacttctataaacgacactgctactcgggtggtgcttcgccggcaaaaggacaataagacatataaagcctctgctaaggacagttcaggcttaaataaatacggtgtgcttcaatatacagaaacggtcacagatgacatcaaccaggcacagcttcagcagcgggcagatgtacgccttgctgaaaaaaagggcgtgaaaaaagaactgaaaaatattcaggcagtgggcatcccggaagtgcagagcggcttgcccgtctatatttcgattccggaggccggtatcaagaaaacctattgggtagatacggaccggcatgaatttaaaggaacgaaacatacgatgactattgatgttgtcgaaaagaatacgatgccggaaggagttttctgatgagattaagtgaggttataaaacatttggcggtcggcgcaattgacgctgagtctccggtagaactgctcccggctgaagtcgtttcagtttctcctgtggaaatcaaattaaaagaaaacagcaaactgatcataccggaagacgccatcattatcccaaaacgaatgcagtccggaggagacgatgcactcgaaccggggatcgcctcatgaccgcggctctgactggcgggcaatcgttttttattttagataaggtatagacaaaaccgcttcagtacgaagggtttttatttagcatgtaaaaggagtgggcatcatggccctgacaccagaagtggagtttgaggattttgaagatgagagcgaagtcattgaaacctcgcaaacgtataaaatagattttgaaaacggaagaattacgaatgagctgattacagggcttgaagcgatcaggcagttcgtgtatatcgccttacagacagaacgctatgcgtattccgtatatagccataatgtcggtaatgagcttccggacgtgctgacagatcatgagacgactgatgcctataaaaagatggagattccgaggctgatagaagaggcgctggtttatgatgaccggatatcggctgtaacagattttgagattgaaaaacaaggcgatgcgtttcatgtgtccttcgtggtggagacggatgaaggaacgcttgagattgaggaggtgattggcgaagatgtttgaagatcagacttttgaagcgattatggagcgtatgctgaacagcatttccgcagatattgacacaagagaaggcagcgtcatttataatgcgttagccccggcggcggccgagcttgcgaagtcttatatatggctggatactgtgcttgagctcgttttttctgataccgcacaaggcgaatttttagacaggcgtgcagcggaagcgggaattgaacggacagccgcgacaaaggcggtcagagcgggagagtttacatctggagttactattcctgtcggctcccgcttttacgtggataatctttattttcaatatacggcagacgggacgctcatctgtgaaacacctggtgaagcgggaaacgccaatctgaccggacgcaatttactgtcattggataccattcccggtttagaaacggccattgtcaaagaaatcctgattccggggcgcgaggaagagggagatgacagcttgcgagaacggtattttacaagggttcggcgtgaggccgtcagtgccaataaaatgcattataaagagtgggctgaggaagtggacggtgtgggaaaggcaaagatcttcccgctttggaacggtgaaggcactgtcaaaattgtcgtcaccaatgcgaatcttgagcccgcttctcctattttaattcaaaaagtgaaagattatatcgaccctgaaccaggacagggagagggacaggcgccaatcggagccgttgtcacagtggagagcgcggtctggaaagaagttgagatttctgccgaagtgctgcctgagatcaatcactcaattgatgaagtgaagtcagaaattgaggaaggcgttttaaatctctttaagaaaatggcttttgaagataacgtcatccgcctttctcaaattaacaatatcgtctataattcaccatcagtcagtgactactccaatattcaaatcaacggcacgtctgaaaatctggtgctgagcgacgtggaaattcctaagcttgggcaggtgaagatcattgagcaaacaagatgacatgacagcgtatctgccgccgtttcttaccagccttaaagaaatggctgagctgctgaaagcggaagcgcctgagtttgataaacaaaatgacagcatatttgatctgacggatcagttattcgtaccgacggcgacatgggggctcagccgctgggaaaagattttaaacgtaccgcgggaatcaggtgacactgatgagatcagacgattgagactcatttccaaaatgtcgaacatcccgccaatcacatacagggccattgagcaggcggtaaaccgtttcttgaaaaacccgtctgcacaggtccgcctgcttcccggcgaataccgatttaacgtcgatatcaatgttgatgacctccagcacatgaatgagctgatcgaagcgatagaaaacatgaagcccgctcatttggcgtatacgctcagaggcggattgaacgagacgctgcaaatcaaagacacagtcatcctgaatcatcgcagataccgaacagccagtgagctcaaggtcggttattctgtcactcttaacaataatgaggtggtcttaacttgatttcaaccatatacagagaacgcacagcggctgatctaaaaagcagaatcgatcacgtgctgctcaacggccaaaaaacagaaatagtagagctcaccattgacggtgcgaccgtcaccgttctgacaaaacgtgaggaagacatcaagcatatcgaaacggtacaaatttttgacgagctgggcaatgtgatcacagagagaaagactgacctggacgtcagcgaaaacagaacactcgatttcagatttacctttgaggtggtgtaaacatggcatacgaagaaaaaacagactggcttccggacgacccaatcaacgaagatgacgtcaaccgttgggaaaaaggaataaaagacgcccacaccgatctggctgctcacaaaaacgacatgaacaacccccacaacacaacaaaggcgcaaatcgggctggggaacgtggataatgtgcagcaggcggcgaagaaggattttgacaagcatgagcaagatcaggtgcggcatgttacatcgacagagcgtgaaaactggaacgcaaaagaaactccaggtgaagctcaaaataaggcagatcaagccgaagccaacgcaaaagcctatacagatagttttgctgcacgaagagataatcctaaccaagtaacaaaagcacaagttggacttgggaatgtcgaaaatgtgaaacaagcctcacaagcagattttgatgctcatttaagcaatactaaagttcatgtatctgaaggggaaagaaacaaatggaatgctgcccaactaattaaacttactggagacgatggtaaaagaatacaactccaagacggtacagatattcttacattatcttctgggttttattgtgcagttggtcagtcagttgtaaacaacccggtggaaggcgatgcaacttggtataactacgatattgtagaaggcggttcaggaaggaaaacaatagtagcttaccaaagttggggaagcatgatgtggattggaatggttcacactgatggagaatttagaggatggaaacaaattgcaacaacagattttatagatagagttcaatcagaattagatattcataaaaatgataaaactaatccacattcagttactaaacaacaagtgggtctcggaaatgttgagaatgttaagcaggagacacctgatggtgcgcaaaaaaaagctgatactgctttgaaccaatcaaaagattatactaacagcacggcctttattactagaccattaaattcaataaccgatgcaaatgatttaaatcttccgcctggcacttatcgtttagacactaattacatgaatgcaaatccagtattgcaaaatcaatttccgctaaatgataacagaacaggtttattaattatctacccttctgcaaataaatgggctacacgtcaagattggtttagcatctctacgaaaacactttatacaagggtagctgttaatggtactgagtataccgattggtatatattggaaacatcggaaggttcacaaagtaaagcagataaagctttagctgatgctaaaaactatgttgaaacaaattatacaaatcaaaaattaactgttctaacaggatcaaatgcaatccaagatgcgagaataagcggaaatgattacaaatacggaatcacttttatggacattggggccaataacactacaggatacccgctcacttatggatttgtaaaaaatgaaaagcatagtaattatcgctttactcagtatttctatggaaatgcagacacaactagtggaagttatgatcatgtagggacttggatccgccattggtggtcagattcaggctggactgcatggcaaaagatatcaggatttgctcacgctaatattgggactactgggcgtcaagctctgattaaaggagaaaataacaaaattaaatttaaccgtattataaaagatagtcataaattgtttgatacaaaaaacaataggtttgtagccagtcatgcaggaatgcatttagtcagtgctagtttatatatagaaaatactgagcgatactccaattttgaattatatgtttatgtaaacggcacaaagtataaattaatgaatcaatttagaatgcctaccccttccaataacagtgataatgagtttaatgcaactgttactggatctgttacagtcccgcttgatgcaggagattatgttgaaatttatgtttatgttggttattccggagatgtaatacgatatgttacagattcgaatggagctctcaattattttgatgttctggagcttggcggaagaaattacccgagagtttaggaggtacctttatgatcttatatgatgccattatgtacaagtatccaaacgcagtatcgagaaaggattttgaattgcgtaatgacgggaacggttcatacattgagaaatggaatctccgggcccgttaccgactcaggcagaactcgaatcctggtgggaggaatcacaaaaaaacccgccgtatgagccgcccgatcaggtagagcttctcgctcaggagttgtcgcaggaaaagttggcacgtaagcagcttgaagagctgaacaaaactttgggaagcgagctggcaggtataaagctttcactactttctttgaaaggagattatgctgaatgaattattgggtgcttgccctctattatgagtgggcgacagcagatatggtaaagcaagcattagcatataaagactgttcaattgaggatctggcagagggtgtgaacaaaaagctgatcacagctgaccagtataaagaaattaccggtaaagccatgtagtaaggcttttttattttgcctgtttttagatcaaaggaggatgaagatggtgaagtatcaatatgaatttcctctcgataggactggaaaagctggcgctgtaaagccctatcgaggaggaaaaaatgattttgtgacacctgtttcgaatttgtcaggcgtagcggagattttaacaaatgcttccttaaaggcgactgaggcatatagtcaactcgggcaggacaggcttggcgcagttctgatttcgaaagtgaagggctgggcgtatgcagatcgtgaaggtacgctctttatagaagaaagcgacaacaacaatgtttggacaacgacagcagcagttaatgtcgcagcaggtgtcctgacagcgacggactgggtatatctttctaaacgctattaccgcttccgctatgtgaacgggaatcttcagcaatccgagtttgtattataccaatcggtcggtgcgggtgagatggatgtgcgtgtcaatggaaaaacgcctttacagattgactttgcggataatcaaacacacgatggacggctgaaagtcgaggctcgcaaaacatttgactttgtctttcatgaaaatgcagagtccgccggcgagggggctgccttacctgttgacggtgccgcgcatttactcgttgaagtctacggcacagcagaaatgagcgaagtcaaattttggggcaaatcggtgtcaggacagaaactgccgatcagaggcgtaaaaactgatgatgctaccactgcctccagtacattaggaaaagccgaggcatgggcctttgatattaaagggtttaaggagattatcatggagattatcagtatcaccggcggtactctttcggtaaaagggaccgcggtttcataacagtctcggccctcggaagggaggtgatctgcatgtgaaggaggagtgagagatgcagcaagaggcagatgtgaatgtgtttcagcaagatttattagacatgaaaggcgagcacaaagcacttgagcagagggtttctgcattagaacgcgtgtctgaccggcaagaccagcaaatcatgacgctgaacgaaaaattaaacaaaattgaagaaaacaccacgtggattaaacgcaccatcacaggtgccatcattacagcagtgtctacaggcatcattggcggagccatcgccattatgtacagcctgctgcagcattaaaggggattttcatgaacacgtttgacaagggcacggtcatcaggacggtgcttcttttaattgctttaatcaaccagaccatgctgatgctcggcaaatcaccattggacattcaggaggagcaggtcaatcagctcgctgacgctctttattcagccggttccatcgcatttacaattggaacgacacttgccgcttggtttaaaaacaactatgtaacagaaaaagggaaaaaacagcgcgacttgttaagggacaataatctgacgaaataaggagagatgaaaatggttaacattattcaagactttattccggttggcgcaaataaccgtccaggctacgcaatgacgccgctctacattacggtgcacaatacagcgaataccgcagtaggagcagatgctgcggcccatgcccgctatttgaaaaatcctgatacgacaacaagctggcattttacagttgatgatacagaaatttatcagcatctgcctttgaatgaaaacggctggcatgcgggagacggaaatggcagcggcaaccgggcttctatcggaattgaaatttgcgaaaatgccgatggcgattttgcaaaagcaacagcaaatgcccagtggctcatcaaaacattaatggctgaacaaaatatcagtctcgccaatgtcgtccctcataagtattggtcagggaaggaatgtccgcgaaaattgttagatacgtgggattcgttcaaagcaggaattggggaggcggcagccaaacttacgtcgtgaaacagggcgacacacttacatccatagcgagagcatttggtgttacggttgctcagctgcaagagtggaacaatatcgaagacccgaatcttattcgcgttggtcaagtattaattgtaagtgctccatcgtccactgaagaacccgagctctatccgctccctgatggtatcattcaattgacaacaccttatacctcaggagaacacgtctttcaggtgcaacgagcacttgcggctctgtatttttaccctgataaaggcgctgtcaacaacggaattgacggcatttacggcccgaaaacagctgacgcagtcgcgcgttttcagtctgttaacggcctgactgccgacggtatttacggacctgcgacgaaagcgaagatcgcagcgcaattaagctgatcacagaccacaaaaatcccggagctggttccgggatttattttttcttcttcaactttttaataattccagcactgcgctccctcacccgaagtgagtacccggaaagcccaaaccttccgtaatcaacaaacttcacacgcctcaccaattttttcactgtatcacctgacattatcctctgtttgtatttattatatgtaaccctttaagaaaaggaataaggacaagagctgttttcccttgtccttttagtgtgatcatgctttttttcgtttatactcgtcaatcagccgttcgttttctttgaagattcttgctgtatgcggactgacttgatagcttgcgacactggtggttgaacgttttttcaggattttaaacggcttcgccgctctgggctcgcatctgttttgaaacgcacgttccattatccttcaccttcctcctcaattggcagcaccaaatcatatatgctcgttaatgacgtaaatagcaaataatcaaattccgtgacaatgctgtcagacgtcagcttgatgacatagttctgtgtctcgatggtaaaagggatgagaaccacttttccgtattggtcgtaataaacatcctttcgatcgagccgtgtttgtacatctgccggatcatccatatgctcggttaaccggtctttatcagcctgtgtcgaatagtggcaaagagaagccgttaagttcattttatcagcataggttttcagcagcttatcaataccttcagcataagcatctatacttccataataaacatggatcggttcgtttttcaataggtattggtatgttttcagccgattaaggtatatgtggagcatttcgttgttttcttcaagaatttctcttgtgtctgtttcaagctcgctgccggccagttttttgacgtatgcacttaagaagataaaagcatcaatcaaagcaaaactgactgcgacaatgagataccgttcccagtgggtaaatagggaagtgggctcatatgtccagtataccatagcgcccagaacaaacagcaaataccaagttttccggatggcggacattttttctttgaccttcgcttcgaaacgccacgtggcatacacgtataaccccagtccggccacgatgcaccagaccatgatctgaaagaataaaaccatattcgaatccctcacatctgaaataggttctgcttattgtattcgagagatccggatggttttcctgttccatcaaaaaaaccgctcctttgacagaagcggtgtgacattaaaatatcatatttaaaataaagtaggcgatggcaccaagtgtcgctgaaatcggaagcgtgatgacccatgtaatgagcattcgcttggccgtaccccagtttacgccttttacccggtgtgacgcaccgacgccaagaattgatgaagaaatgacgtgggttgtactgaccggcaaatgaataaacgtggcgccgaaaataatggctgctccggttaagtcagcagaaacaccgtttaccggacggattttcataatctttccgccaacggttttgatgattttccagccgccgattgatgttccgaggcccatggctgtcgcgcaggcgaattgcacccaggtaggaatatcattagcagaagtatgtaaattcgctgtgatgagagccattgtgataattcccattgctttttgcgcatcgtttgttccgtgtgtatacgattgcagggcagctgttacaatctgcactctgcggaattgcttattcgttttcgccaagttgctgtctttgaaaatcagcttaacgatgctataaagaataaaaccaaggacaaaggcaataattggtgataggatcagtgcttcaatgattttaatgaagcccttatagtttaacgctgcaaatccggctgccgcaatggctgcaccggcaatagcgccgatgatggcatgggatgagctgcttgggataccgtagtaccatgtgataaggttccaggcaattgcagcgagtagcgcagccaaaatgacaacagagccattttccagcgtataaggatctacgatgtctttcgtaattgttttggcaacacctgtaaacgtcattgctccgataaagttcatcacagccgccaatataatggcatggcgcggtttcaacgcttttgttgatactgaagtcgcaattgcgtttgccgtatcatgaaacccgttgatgaaatcaaacgccagagcacaaatgactattagtatcgttaatattaatagaatatccatttttacccctcgttacgcgtttttcataatgatggtttcaagattattggcaacactttgacaagagtcggcgatttcttcaagcgtttcgtaaatttcacgatattgaatgactttgattgggtctgtttcatttccgaaaagattctttaatgattttctgtgcaagttgtcacagctgtgctcatactcttttattttgattgcgtgaggctgaatatcctttaagcgattttctgccagcagctcgatcgtaatcaaaatctctttcgcgcattctctgatgtatccgctgaatttatcgatatgctcgtctgatgaagtaattgagaaaatctccatcatggcagagaaatgttcgattccgtcaagcacatcatccaagctgtttgtcagctgaaggatatcttcgcgctcaataggagtgatgaacgctttgttaagctctttaatcatgacatgaacatgattgtcaccttttgtttcatattcctttaacgtatctgcaaattctttaagagtcgtttggttagtgaccttaaaattcacaaaatattctgcagtttcgtctatgttctttgcaatttctgttaaaaggagtgagaacttatctttttttcttcttatcattaaaaaccctccatagtttgaatgaacaatgcacacatcaaattattatatagccttttgtcgaaaaaaaacaggtaaagtcgaaaaaaacgtatcttgacttttttgataaatcgtgtctccttattttgacctacttcgctttaaaaaaacgacccaagtttgcaaaaactttctgcttaacgtaaaaagtatatcaaaagttgtgtttttcctgtcaacttttatcttctgtttcaccaaaaaacggttccctaaacaagggaaccgttttatcagcttgcttttcgttttttcatcccgtaataaacaggcagtccggcaaggccgatgaggatggataatccgcagctcatagtatctgtaatgagtgtgctgcctagcacaaagaaggagcccgcgattgccagaattggcataaatggataaagcggaacactgtaggcgcgcttttttccctttgctcgcttgcggagaataaacactgcaaaaaaggccatcacataaaaaatgtagatcatgaaaatggagatttctgagagcttatcagggttgctgatcagcatcataatcaaagccaaagcaatttgaaaagaaatcgcaatccatggtgtgcggaacgacgggtgtacatgtgacagtttttcagcaaaaggaagctgtttgcgttccgccattgcaaatgaaacacgcgggaaagaaagcacctttccatttaagcacccaaagatgctgacgataatccctacactgatcagctttccgccaattgacccgaacagcatggttgccgcggtgcttgtcgcattttcaccaagcgtgacaatttcgttcgctgacaggatgtggagcaatgcaaaattaatgaaaatatagatcgccgttacaattaataatccgcccgtcatagcgcgtggaagcagcttttcgggatttttcatttctccgccgagagcggcaaggagaatccatccgtcataagcaaacaacgtagctaaaatagccgccccgaagttcatatcggaaatgctttcgtttactgctgtgaagatgtgctgatcgcctttccaaaggccaaagatgatgatgcaggcaatcggaatcagttttccgatcgttgtcagcgtttggacaaaaccgccatattttgtaccaataatattaatgacgcataaaaagagaactgctatgattccaatgacttttgatagtccagatccccagccgaaaagattcgccattaaagatccaaaatataaacccagcgcgccgataatcgccggaccgtaaatgataatctgcacccagccgcacaaaaatccccaaaactcgccgtacacttcttcaaggtacgtataaagcccgccggtttttggaatctgcgttccgatttccgcgattgtcaaaccgcccgccagagttaaaataccgcctaacagccaggcgaaaagcgccgtttttgaatcacctgaataagcaagcacagcgccgggcttcataaaaacaccagaaccgataatggttccgatgacaagagtaagggcaaacaagaggcctatctcttttttcaaaccgttgtcttcagtatgcatgtccttaacctcctatgatgttgaagcttcatgttgaagaatctattttttcatattgtaaaccctattttagaaaagtgaaataaaataaattttctgattttcgaaatttgctttgtgtacagcagataaaactgtggaaacacctgttttaacaatctataagcgaataaacttcatgatttttatttgtaaagttcgtgttttctgaattaggattttagccggtgtacagaggggagatgagaattcagaaaatgaacgaaccttcggtgaagctgatatgttgactttctcatgcgaataaaatactttgttattagaacaataaatatacaactatgatatgatatctcgaaatcgagataaattaacctggagggacagcatatgaaagttaacggcattcaccacgtatcggcattaacggccgacgcacaaaaaaacttggatttctataagaaagtattaggattaaagctcgtcaaaaaatccgtcaatcaggatgaaccgacaatgtaccatctgttctacggagatgaagtggcaaacccgggaactgagctgacgtttttcgagattccccgcattgcaccgtttcatgcgggaacaaacagtatttcttctattggtttgcgcgtcccaagcacagaagccctgcattactggaaagaacgttttgaagagcagcaagtgacgcacagcggcatttccaaaagagccggacgtgacatattggcatttcaagatcatgaagggcagcgacttgtgctgactgctgatgaggaaggaaaaggatatggcctgcctgttaaacagagcggcataccggaagaattttcgtttcgcgggttagggccggttgaactgactgtgccatatgctgaaccaaccttacacgtattgacgaatattcttggatttacagaaatcagccgtgaaccagtcgaagggcaaggaaccgccgttattttggaatcaggagaaggtggtgctgcaacggaaatccatttaatagaaagaaacgatcttccgcgcgagcgtcaaggcaaaggaagtgtccaccacgtcgcatttcgggtaagagatgaagaagaacttgccgggtggcaccggatcatcagccgcgaaggctttagcaattcaggcattgtggagcgctactatttcaaggcgctgtatttcagagaaccaaacggcattttattcgagttatcaacagacggaccgggctttatggtagatgaaaatcttgatgagcttggccaaacgatcgctcttccgccgtatcttgagcatcgaagagctgaaattgaagcaaaattgaaaccgatccagtaaattgtgattcatttgccttccggcgtgccggaaggctttttttattaccataattaattttgacctaaacagcatgccttattagggaggaaatatcagatgcttattgggagaaatggcttaaaaccctttgcaaatatgggtgattggcatgaaatgacctcggcaaaaatattgtctttgtttattaatagtttattcatatttgcttgttacactatttcaaagttagacaaaaaggagtgaaaaataagtggaaaagaaaaaacgcgagctggatatcgtcctcctcctcattttgctcgcatctgcattcttaaatatctataacatttggaaggacgacacggtgaatccttattacaccgcggcagttacaagtatgatgcaaagctttcataatttcttttatgcttcgttcgatgctgccggctttataacagtggataaaccgcctgttacataccaaatccaaacgatcagcgcactgatattcggtatgcacgggtggagcgtcattctgcctcaggcattggcgggtgtaggttcagtccttcttatgtacttgctgataaagccgacattcggaaaaacggcggcgcgtattgcctcatttgtaatggcatgtacgccgatagctgtagctgtagcacgtacaaacaatgttgatgcattactggtatttttcttattgcttgctacatggcttctctttaaagcgatcagaacaggaaagctgatctggctgttagcggcgtttttcgttgttggagtaggtttcaatacaaaaatgctgcaggcttacatgattttaccggccttcctattgttctatttgattgcggcaaatgccgcggtgaagaaaaaaatcatttcgctggtaagtgcgttagccgtattagcagccgtttcgttatcgtggccgctcattgtcgacaatatccctgcaagcaagcggccttatatcggaagcagccaaaccaactctgttttggaattggctttcggatataacgggattcagcggctgacaggccaaaattcaggcggcgtccagggtgcgccaaacaaagacgcttcaaaagaaatgtcttcttctgataacactcaagcaccgcctaatcagtcatcaagcagcagctcatcaaatgatggtaaatcctcaaatggcaatatgacggcacctccatccaatggccaaatgccaagcggaggagaaatgccaagcggcggtcaaggaggccctccaagcggcggagatggcggccaaggcggacccggcggagacggagggaaaggcggtacaggaaccggttcgaaaatgcaatcaggttcagggatgtttggaacgggaacacctggtccactgcggcttttccaacaagagttatctgatcaaatcagctggcttctgccatttgcgatatttggaatcgcaggcttactgatcgctggcgcaagagaaagaagaagattatctatagagcagaaggaaacggtgttctgggttgcgtggcttgtaccgattgccggattcttcagtgtcgcagaatttttccatcattattatctcatcatgctggcaccgccgattgcggctcttgtcggtgcggggtgggttgctcttgttcatctgtaccgcaatcagacaggctggaaagcatggcttttgccgggagcaattattgcgacaactggatttgaattgtttattctcagaaactacaacgatcaaatcggtgcaggctggagcatcggtgtaggtgttatcggcgtgttgtcagcgattgctttgctgttgttaaaacagcgccaaaaaccgttcagttattatgtttcacttgcagctctcctcgcattgctggtgatgccgatttattgggcaagtacaccgcttctgtacggaggcaacagctcactgcctgaaacaggccctcagctcgcatcaatgagcggaaaaggcatgggaatgtctgatgcgactgtaaatgaaaaactgatcaaatatctagaggagaataactccggagctgaatacttattcgccacaaccgattcgaacacagcggcaccatatatcattaaaacgaaaaaagctgtcatggctattggcggatacagcggttctgacccggcgatcacactgactcaattcaaaaaacttgtaaaagaaggaaaagtgaaatacttcttggcttctggaatgggaagaggcggaaacaatgacattgttgaatgggttgagaaaaatggaaaagaagtagcatcagaaaaatggcaatcaagtgctgatcaaaaaacagaaaatactgattcagctgatacatcaagcagcaaggcttcaggtaaaaacggaaaaatgggcggacctggcggaatgaatcagtcagcaacattatacgaactacatgctgatgaataggaggcaaaaacatgagcagacatattcaatattcaattgttgtacctgtgtataatgaagagcttgtcattcatgaaacctatcagcgcttaaaagaggtcatggatcaaacgaaggaaaactacgagctgctttttgtcaacgatggcagcaaagaccgcagtattgagattttaagagagcacagcctgatcgatccgagagtgaaaattattgatttttcaaggaattttggacaccagatcgccattacagcgggtatggattatgcacaggggaatgcaatcgtcgtcattgacgccgatttgcaggaccctcctgaactgattttagatatgattgaaaagtggaaggaaggctatgaggtcgtgtacgccgtgcggactaaacgaaaaggggaaacctttttcaaaaaacaaaccgcggctatgttttaccggcttctcagcggtatgacagatattgatatcccgattgatacgggggattttcgtctcatggacagaaaagtctgtgatgaaatgaagagattaaaagaaaaaaatccatttgtcagagggctagtcagctgggtgggctttaaacagacagcggtcgagtatgtacgtgatgaaaggctcgccggagaaacaaagtacccgctcaagaaaatgctgaagctgtcaatggacggcatcacgacattttcacataaaccgctgaagctggcaagctatgcggggattttaatgtcaggtgctggatttctgtatatgtttatcgtgctgtatctgaagctattcacagacagcacgattaccggctggtcatcacttattgtgatccagctcctgttcagcggcattgtccttctgattttgggcgtgatcggcgaatatatcggcagaatctacgatgaagccaaagacaggccgctttacatcgtccaaaaatcgtatggaattgaaaataaaagactctatagagaccagcatatgtcataaccttaaaccccctgtccgttacggacagggggtttttatgctctgcgcacgatctaaagcaaaagatgcagatagatatatggagattgggtaaagaagagattgtgagcttgtactgcggttcagtcatgctgaaataaaaacagcaaaacttaaagatttcgtcatcggctttgctgcatgtcagctgttagattgggggcttttaagaaacgcatgattagagccgtaccagttatgtttaatagaatactggtacccaatacaattccccacgtcaacgtcgattcagagagaagaaagctcagcaaaagaaaagccaatcctgcgcagatcatactcagtcccacggttttcatgttcatgcctcctagcaaacgatgtttctagcgtctgatgagaatgatgtcaatctgtatgatatacggatatctcgtcagaaagtttcatagaacaattaggtcttttatctaataaaaagcctcagaccgcttttgcggcctgaggcattatgtcttacgaagttttctcttctttttgatcaagtttaatttttttcgtcatttctttgccgtttcggagaattttcacttcaacggtatcaccgatctttgcgtctttatataagatattgcgcaattcactgcctgtatcaatttctttaccttttaggccgatgataatatcctccgcttttaatccggccttttcagcaggagagcctgaagcgacctcacggatgtaaacacctttattcagctggctgccgaacaggccgagtgtgccttcttggtaattttgcggcacttgttccagatcaagcatgctgacaccgatatatggacgttcaatttgtcctttagaaagcagttcttcagcaatcggttttacgtcattgcttggaatggcaaatccgatgccctcaacatcatcctcactgattttcatactgttaatgccgacaattttgccgtctgtatttaacaaaggaccgccgctgttacctggattaattgctgcgtctgtctgaatgacgttaatgctcgtttcgccggctgatgtagacattgaaaccgttctgtccacgccgctaacaattccttgtgttactgtgcgggacagatcttttccaagcggatccccaatcgcaataacggtctcgcctgttctgagatcagatgaatcaccgaagtttgccacttttgtgacgtggtcatcactgatttggaggacggctaaatcagttaacgagtcactgcctaccagctttgcagtaacctcagtgccgtcatataaagataccttcagtgatgatgccccttctacgacgtggttatttgtaatgatataagccttgccattctcttttttgaaaatgacacctgaccctgaaccgctttctgtatcttcgctggaatcagaagaactagagccgaacaaagagctgtttgattgtgcctgaagatttgtaatgccgacaatcgctggtgaaaggtcttctaccatatctgagattttagaagagtcctcgctcttgaatgcagatgagctgcttgagcttgatgagctttttttagattcagaggaggtgcttgttgctgtaacagattgcgtttgctgctggctggatgattgttttgcagtgtcctgagaatcatggtcgccaagcggtgtaaacgtgtaaatgccaagggcaagactgccgccgatcactccgccaagcaacggtctgaaccatccgaatcctcgttttttcttctcctgatcatgaatgacattgcgggccgagtaggaggtgctctgatcgttctctttcgttaaaaagacctcattctcattacctttcgttctgttttcatcacgatagttatccatcatgttcactccgtttctctattttcacatgtctatttatattgataggtttatgacttgagtttatcataaacaaaaactgtgggataaaaatgaaaagattatgggaaattgtgaaaaagtgcggaaaacggtacacttcatattgtatatgaaaggactgagtcgatggaacagattggattgattggatatggcagcatggcggatatgatcgccagacagctgttgaaacatgaacaaataaaagagaatgagctatttattgagacgagaacgaagggggagcggctacgggcactcctgtcagattatccaaatgtatcggctgatccgttggagaattgggcaaatacgtgccaattgattttgatatgcgtcccgccgctccatgtcatcgaaacaatgcgccgtctgcacccgtatgtgaacagaaatactcacatcgtatccatagctgccggtgtgccgctgcgtcttttggaggcagaaacagaagcgggtatctcacgtgttattcctgccattacgtccgaagcagaagctggcatctcacttgtcgttcacagtgaagcactggctgcggagaaaaaagaacgtctgaatgaattgttatcggttttcagccgtgtacgagaaatcaaagaatcgaatgttgatgcggccagcaatttaacgagctcggcaccaggattcatagcggcaatcttcgaagaactggcactgtctgcggtcagaaacagcagcctgtccaaagaagaagcctttgattttctgattcattcgctatacggaactggtaaggtgctgatcgaaaaaaatatgtctttcgaggagacgctggaacgtgtcgcaaccaaaggcggaataacgggagagggagctgaggtgatacgcgcctctgtgccggacgtttttgatgaggtgtttgaaagaaccctgaaaaaatatgaactgcttacagaacaagttggtaaacagacatgaatccttgaaagaggattctttttttatcactgaatggttgagattttccccagttatattgcatttttcctctttttttaatataatttgttagaatattcataatttagtaaaaaaggaggagctctatgaaattgtacatgtcagtagatatggaaggtatttcgggtcttccggacgatacctttgtggattccagcaagcggaattatgaacgcggacggcttatcatgactgaagaagcaaactactgtattgctgaagcgtttaacagcgggtgtaccgaggtgctggtcaatgacagccattcgaagatgaataatctgatggttgaaaagcttcaccctgaagcagacttgatttctggtgacgtcaaaccattttcaatggtggagggactggatgatacgtttacaggcgctatgtttctcggttatcatgcgagagcctcgactcccggtgtcatgtcacacagcatgattttcggcgtccgtcatttttacataaacgatcggcctgtcggtgagcttggattaaatgcatacgttgccggttattatgatgtcccggtattaatggtagccggggatgaccgggcggcgaaggaagcggaagagcttatcccgaacgtgacgacagccgcagtcaaacaaaccatttcaagatccgcagtgaagtgcttgtcgcctgcgaaagccggacggctgttgacagaaaaaaccgcatttgccctgcaaaacaagaacaaagtcaagccgctcacaccgcctgacaggccggttctgagcattgaattcgccaattatggccaagcagaatgggcgaatctgatgccgggaacggaaatcaagacgggaactacaaccgttcaatttcaggcgaaggacatgcttgaagcctatcaggcgatgcttgtcatgactgagcttgcgatgcggacatcattctgctaaaggggtgttttaggctttggcgcgatacatgataaagcgtttttgggcaatggcagctacgattttggtgattaccaccctgacttttgttctcatgaaggtcattcccggatctccttttaacgaggagagaggcacaaatgaagccgttcaaaaaaatctcgaagcctactatcacttagacgatcctctcattttccaatacattttctacttaaaatccatcattacattcgatttcggaccttcaattaaaaaaccgtcggacagcgtaaatgatatgctggaacgcggatttcccgtttcctttgagcttgggatgacagcgattgtcattgctgtgatttctgggctggtgctgggcgtaatcgctgcactccgccgcaatggctttttggactacgccgcgatgagtcttgcagtactcggcatctccatcccgaattttattctggcaacattgctcattcaacaatttgctgtcaatctcaaactatttcccgctgcgacatggacgagcccgattcatatggtgcttccgaccgcagcgcttgctgtagggccaatggcgatcattgccaggctgacacggtcgagcatggtcgaagttctgacacaggattttattcgcacagcaaaagcaaaagggctttctccgttcaaaattatcgtaaaacacgcactcagaaatgcactcatgcccgtcattaccgtcctgggcacactcgtcgccagcatcttaacaggaagctttgtcattgaaaaaatctttgccattccgggaatgggaaaatattttgttgaaagcattaatcagcgggactaccccgtgattatgggaacgaccgttttttacagcgtcattctgattatcatgctgtttttggtcgatttggcctacggtctcttagacccgcgcattaaactgcataagaaagggtgaagcgtgtgaatctccctgtacaaacggatgaacgccagccagaacagcacaatcaggtgcctgatgagtggtttgtctcgaatcaggaaaaaaatcgggaagccgattcggtcaagcggccgagtttatcatacacgcaggatgcctggaggaggctgaaaaaaaataaattagcgatggccggactctttattcttttatttctttttgtcatggcagttatcgggccctttttatcgccccatagtgtcgtacgccaatcgctgacagaacaaaatcttccgccctcagccgatcattggttcggcaccgatgaactcggccgggatgtgtttacccgaacatggtatggcgcgagaatctcgttgtttgtcggcgtgatggcagcactgattgattttttgatcggtgtcatttacggaggcgttgccggctataaaggcggcaggattgacagcattatgatgcggattatcgaagtgctgtacggcctgccgtacctgcttgttgtcattttgctgatggtgctcatgggaccgggactgggcacgattattgtggcgcttactgtgaccgggtgggtcggcatggcgagaattgtaagaggccaggtgcttcagattaaaaattatgaatatgtactcgcctcgaaaacctttggcgcgaaaacctttcgcatcatccggaagaatttgctgccgaatactatgggagcgatcatcgtacaaatgacattaaccgtacctgccgccatattcgcagaatcatttttaagctttctcggcctcggcatacaggctccgtttgcaagttggggcgtgatggcgaatgacggcctgcctacgattttatctgggcattggtggcgcctgttttttccggcctttttcatatctctgacgatgtacgcgtttaatgtgctgggggacggattgcaggatgcgcttgaccctaagctgaggaggtagctgtatggaaaaagttctgtcagtccaaaatctgcacgtgtcttttacgacttacggcgggacggttcaggctgtcagaggggtgagctttgatttgtataaaggagaaacctttgcgatcgtcggcgaatccggctgcggcaaaagcgttacctcccaaagcatcatgggcctgcttccgccttattcggcgaaggtgacagacggcagcattctatttaaaaacaaagacctttgccgtctctctgacaaagaaatgagaggtataaggggagccgacatttctatgatttttcaagacccgatgacggcgttaaaccctacgctgactgtcggcgaccagctggggaagcactattgcgccacaaaaaaacgagcaaaaaagcggcgcggaaagaggtgctttccatgctgtcattggttggtattccagatcccgaagagcgcctaaagcaatatccccaccaattcagcggcggcatgagacagcggattgttattgcgatggcgctgatttgcgagcctgacatcttaattgcggatgaaccgaccaccgccctggatgtaaccattcaggcacagattttagagctgtttaaagagattcagagaaaaacgaatgtgtctgtcattctgattacacatgatttaggggtcgttgcccagatagctgacagagtcgcagtcatgtatgccgggaaaatcgcggaaatcggcacgagaaaagatattttttatcagccgcagcacccttatacaaaaggactgctggcttctgttccgcggctggatttagatggcgctgagctgatcccaatcgacggaacgccgccggatttattttcgcctccgccgggctgcccgtttgccgcccgctgtccgaacaggatggttgtgtgtgacagggtgtacccgggccagacgatcagatctgactcgcacaccgtcaactgctggctgcaggatcaacgagcagagcatgcggtgctgtcaggggatgcgaaggattgaacatgaaaagggggaagaggatgaaacgagtgaaaaagctatggggcatgggtcttgcattaggactttcgtttgcgctgatggggtgcacagcaaatgaacaggccggaaaagaaggcagtcatgataaggcaaaaaccagcggagaaaaggtgctgtatgtaaataatgaaaatgaaccgacttcattcgatccgccgatcggctttaataatgtgtcatggcagccgttaaataacatcatggaggggctgacgcgtcttggcaaagatcatgagcccgagccggcaatggcggagaaatggtctgtttcgaaagataataaaacttacacatttacgattcgggaaaatgcgaaatggacaaacggagatcctgtaacagccggagacttcgaatacgcgtggaagcggatgcttgatccgaaaaaaggcgcttcatcggcattcctaggttattttattgaaggcggcgaagcatataacagcgggaaagggaaaaaagacgatgtgaaggtgacggcaaaggatgatcgaacccttgaagttacactggaagcaccgcaaaaatatttcctgagcgttgtgtccaatcccgcgtattttccggtaaatgaaaaggtcgataaagacaatccaaagtggtttgctgaggcggatacatttgtcggaaacggcccgtttaagctgacggaatggaagcatgatgacagcatcacaatggagaaaagcgacacgtattgggataaagatacagtgaagcttgataaggtgaaatgggcgatggtcagtgacagaaatacagattaccagatgtttcaatcaggggaacttgataccgcttatgtccctgctgagctgagtgatcagctgcttgatcaggataacgtcaatattgttgaccaggcgggtctctatttctatcgatttaatgtcaacatggagccgtttcaaaatgaaaacatcagaaaagcctttgcgatggctgtggatcaagaggaaattgtaaagtatgtcacgaaaaataatgaaaaaccggcgcgtgcctttgtatcgcctgggtttacgcagcctgacggcaaagatttccgtgaagcaggcggagacctgatcaagcctaacgaaagcaaagcgaagcagctgctcgaaaagggcatgaaggaagaaaactataataagcttcctgcgatcacgcttacttacagcacaaagccggagcataaaaagattgccgaagctattcagcaaaaattgaaaaatagccttggagtcgatgtaaagctggccaatatggaatggaacgtatttttagaggatcaaaaagcgctgaaattccaattctctcaaagctcatttttgcctgattacggggaccctatcagttttctggaagcctttcaaacgggaaattcgatgaaccgcacaggctgggccaataaagaatacgatcagctgatcaaacaggcgaaaaatgaagccgatgaaaaaacacggttctctcttatgcatcaagctgaagagctgctcatcaatgaagcgccgatcattccggtttatttttataatcaggttcacctgcaaaatgaacaagtaaaaggaattgtccgtcaccctgtcggctatatcgatttaaaatgggcagataaaaactgatggcggtgattgaggaaatactgcttctttatgcgaaggagcggtattttttctctttcttgcacgtatacgtagggtgcagagcaaatgaaaggagtgttttcgttgaattacaagccgaaagcgctgaaaaagggtgatacagtcggagtgatcgcgcccgcaagtccgccggatccaaaaaagcttgacaccgcgcttttatttttagaagagctcggtcttcaggtaaagctgggcaaggcgctgaaaaaccagcacggctatttagcgggacaggatgatgagcggctggcggatctccatgagatgttcagagacgaggaggtaaaagcagtgttgtgcgcatgcgggggttttgggacaggacgtatcgccgcgggcattgatttcagcttgatccgcaaacaccctaaaatattttggggatacagcgatattacgtttttacatactgccattcatcaaaacacaggtcttgtcaccttccatggcccaatgctcagctcggatattggccttgacgacgttcacccgctgacaaaagcgtcatataagcagctcttccaggagacggaattcacctatacagaagagctttctccgctgaccgcgcttgttcctggaaaagcggaaggcgagcttgtcgggggaaatctgtctttgctgacgtctacactgggcacgccatttgaaattgatacgagaggaaagcttctgtttattgaagatattgacgaggagccttatcaaatcgaccggatgctgaatcagctgaaaatggcggggaagctgacggacgcggcaggaattctagtttgtgattttcacaattgtgtcccggtgaagcgagagaagtctctctcgcttgagcaggtgctggaagactatattatttctgcgggcaggcctgctctgagaggatttaaaatcggccactgctcgccaagtattgccgttccgatcggtgcgaaagctgctttgaatacagcagaaaaaacagtcgtaatagaggcgggcgtttcagaaggggcgctgaagacatgaaaatcattcgaatcgaaacaagccgaatcgccgttccactgacaaagccgtttaaaaccgcgcttcgcactgtgtatacggctgaatcagtcatagtaaggattacttatgacagcggtgcagtcggatggggagaagcacccccgacgttagtgattacaggagacagcatggatagcattgaaagtgccattcacaatgttttaaaaccggcattgcttggaaaaagcctttccggctgtgaggccattctgcacgacatccagcatcttcttacaggaaatatgagcgcgaaggctgctgtagaaatggcgctatacgacggctgggcgcagatgtgcgggctgccgctttatcaaatgcttggcggatatcgagatacgctggaaacagattataccgtcagtgtcaactcacctgaagagatggcagctgatgccgagaattatctcaaacaaggcttccaaacgctgaaaataaaggtcggaaaagatgatattgccacagatatcgcccgtatccaagaaatcagaaaacgtgtcggatcagctgtgaagctgcgtttagacgctaatcaggggtggaggccgaaggaagcggtaactgccattcggaaaatggaggatgcgggtctaggcattgagcttgtcgagcagcctgtccataaagatgatctcgctgggcttaaaaaggtgacagatgcaacagatacgccgattatggctgatgaaagtgtttttacaccgcgccaggcgttcgaagttctgcaaacccggagcgcagacttgatcaatattaaattgatgaaagcgggcggcatcagcggagcagagaaaattaatgccattgcggaggcctgcggggtggagtgtatggtcggcagcatgatcgaaacgaagctgggcattacggccgcggcgcattttgcggcaagcaagagaaacatcacacgctttgattttgacgcgccgctgatgctgaaaacagatgtattcaaaggcggcataacatatagcggcagcacgatttcgatgccaggcaaaccgggcctcggaatcaccgggactgcgcttctgaaaggggaaaaagagcaatgatgcacactgtcatatcagcagtggccaacatctggacagcgcctgattcaccgcgtccgtctgatcaattcatgcttcaaccgactgtaaggatcagagactggctggagcgcatgacgtatgatgaacggcttggattatgtacagacaatgtaatccaaactcaggttctctttggcgaaaaggtacttgtgacggcagaacagggggaatgggtttctgtgatcgtgcctagccagccatcccgaaaggatccgcgcggatacccaggctggatgaaaaagaaccagctggaaaaatctatgcccatcgatacacaacacgatgtgatgatcagcaaacctgctgcctttttgtacagaagcaatgaggaaaaggagatcgaattaagctttttgacggttctccccttcattgcaaaagaaaacggatattttaaggtttcgaccgttttgggagaaaggtttgtgaagcaaagtgatgcagtgcctgtcagccaacagaaagggactgctgaagacatcattcaaacgggtgcgtttttccttggccttccctacctgtggggagggatcagcgggtttgggtttgattgctccggatttatgtacagtatatttaaggcaaatggatatagcatcccccgtgatgcgggagatcaggctaaggcggggaagggtgtcccgcttgatgatatgaaagccggtgacctgctgttttttgcttatgaggaaggaaaaggagcgattcatcacgtcggtctctccgttggcggcgggaaaatgcttcattctccaaagacaggaaaatcaatcgaaatccttacattaaaagacacaatctatgaaaaagaactttgtgcggtgcgccgctgtttttcagaataaggagggagacaaatgacgccactgcctttgttagaggtcagccagctgaaaatgcattttgacgcagggaaaaagcggacagtcaaagccgtcgacggggtcacctttcagattcgtgaaggagaaacgttcgggctagtcggggaatcagggtgcgggaaatcaaccttggggagagtgctgatgcgcctttatcagccgacagaaggaagcgtgacataccgcggcacaaatcttcatgcactgagtgaaaaagagcagtttgccttcaaccgcaaactgcagatgatttttcaggacccttatgcttcacttaacccgcgcatgaccgttcgagaaattattttggagccgatggagattcacaatctctacaatacccataaagcgcggcttctcgtcgtggacgagctgcttgaggcagttgggcttcatcccgattttggcagccgttatccgcatgaattcagcggcgggcaaaggcaaagaatcgggattgcgagagcactgtcgctgaatcctgaatttatcgtggcggacgaaccgatttctgctcttgatgtctctgttcaagcgcaggtggtcaacctgctgaagcggcttcaaaaagagaaagggctaacgtttttattcattgcccatgatctttcgatggtgaagcatatcagtgacaggatcggtgttatgtacttagggcacatgatggaaattacagagagcggcaccttgtatcgtgaaccgctccatccctatacaaaggcgcttttgtcctcgattccgattccagatcctgaattggaggacaagcgtgagcgtattctcttaaaaggagagctgccgagcccggtcaatccgccaagcggctgcgtgtttcgtacccgctgtccggaggcgatgcctgaatgtggagaatctcgtccccagcttcaagaaattgaacccggccgttttgtcgcttgccatttgtatcgaaatgctgaaacgaaggaaaaagtgagataaataataagagtggctcctttttactagagccactccatttgttttatacttgatgtaaaaactttacacaaaccgggtaagggacagaaaccgttgatgggaggagtgtcaatcggccggtttctttgtctctttcaaacaagacaaggttgcttgtttcttcatttgaagcaacgaggaacctttccgttgggtcaagtacaaagtcacgaggccagtttccttctgtcgacactctttctacgaaagccagctctcctgaatattgattcacttcaaatacggcgatactgtcatggccgcggtttgcgacataaacaaaacgtccgtcctgcgtgacatgaattgcgcttccctggctgttatctgtaaaatcatcagggatggcagaaacgacttggatttctctaaattcgccggctgtcgggttgtattcaagcgcaatcacttcattgcttaattctgtcatgacataagcgtatttttctttcggatgaaaagcgatatggcgaggtcctgcaccgggagcgaaggaatggcttccggattcagtcaacacgccgtcattcagcttataggtgtacagcttatctatacctaaatcaaccgctaccacataattgtgttcaggtgtgaaccccgcgtagtgtgtatgcggtttttcttgtctttcgtgcggcccttttcctgtgtgagcggcttctgaaacaggtgattgcaagctgccgtcttcctgaaccggaaaaacgtgtaccttcccgctgtgataattggcagtcaggacgaattgattttgatcatcaatgcttacgtgacatggcgaagggccatcaattaactgatgattcagaaatgtcaactcgccgctgtttttatcgatttgataggcagcaactccgccttggccgtctgctttttcgatggaataaaggatggtgttgtttttattcggcgccacatatgtcgggttgcccagcttagcggccagctttggctcgctgagtgcttttttctcagtatcaagctcaaatgaataaattccttcgcttccgccttttgtatacgtcccgacatatcctatgtattttgtcatgcgatttcccccttaaaaatgatgtcacctctatattaacgtatcttgataaaataagctgttcaaaacatgaaaaaggggaagattcttcattcgcctcgaatcagcggcattgtgcagcacctgaaggagccgcctgatttaataatttctgacaggtcaatttcgataatgtgatagcctcttttcgatagctgttgattgacatggaggttgccagggagactgatgatcgttttttttccgattgaaaggacgttggtgccaagcgtaaattgttcgtcctcgggcacctcaataagatcataacgttttgccagcatatcggctgcatctggctcaatggcctgtggataaattaacgcttcgctgtcagatacaatgttaaatacgcagtccaaatgcaaaaatttttcatgaagcttcactggaacgatcgtatattcaggaagtgcctcttccagctggccgatagctgaaatgtcggtgcgctggctgattccgacatagacaatgtcatcatcgataatgacgtctccgccttcaatactcgtatcaagcatgcgggtgtaagagataccttggctgtgaaaaaaatcttttataacggcttcttctccttggcgaatcggttcagtcatgcttgacagaaaggctttttctccgatgacaaaccctatatccctagtgaaaacctgttctgggagcccgtcgcgaacgggtaaaaggatgacctcaacgttgtgtgacctaagtgcctccactaagcggctgtgctggtcgtttgctgtttttacatgaatattgtcatcttcaaaatgtttttgtgtttcgtttataacatcttttatggtcatgtgctcaggtttgcataagatcactttctgaagtgtgccgtattccgttcggcataccgttttgtgctgagatttcgggatggatacgtccatttgtttttcctcctaaagtgtgaagaatacatttattattccctcatcatgaaaatcattaaaccattttaaattttagacaaatggaagagaatattgtttaataggagaatataagtgcatttagctaaaagatcagacatcaaaggggagaaaggtatggaaacaccggaaacaagattttgtaaagagtcaaaggttgtgaaaaccagcagggtgttcccgcttgacacgaacaaccataatacgctgtttggcggaaaattaatgagctacatagacgacattgcctctatttcagcggcgcgccattgcagacgtgaaacggtaacagcttcaatggattctgtagattttttaaagccgatcgggcaaaaggattctgtctgcctagagtcatatgtgacatgggtcggcacatcttccatggaagtatttgtgaaagttattaaggagcatttgatgactggtgaacgggaactcgctgccacatcctttttgacatttgtcgcattagattcaaatggcaagccggtgcctgtaccgagggttgtaccggaaacagaagaagaaatcatgctgcataatacagctgtacagcgtgctaatgaacgtaagaaccgcaagaaacacagccaggcgcttgcgaatgcgcttggaactgataagccttggtgaacgttaaacccaaaacataagttgttttgggtttttttttgtacttttcaatggtgattattgcaatggttagtccgtatttgctaggggattctataaaaaagcaacaaatgtcatgttaaattgataattttgtgacaactttattaaagattcattttagatatatcttttattcgtaagatcatgtattttaaagatatattatgaatacatcttttcgaaaggattgtttataaaatgttagataacaaaacaatcgaaattattaaaagcactgtacccgtattgcaacagcatggagaaacaatcactggccgtttttacgatcggatgtttcaagaccatccagagcttttgaacatttttaatcaaacaaaccaaaagaaaaaaacacagcgaactgcactggcaaatgccgttattgcagctgcggcaaacattgaccaattaggaaacatcattccggttgtcaaacaaatcggccacaagcaccgcagtatcggaattaagcctgagcactacccaatcgtcggtaaatatttgctgattgcgattaaagatgtattgggagacgctgcaactcctgacattatgcaggcatgggaaaaagcgtacggagtcattgctgacgcgttcatcggaattgaaaaagacatgtatgaacaggctgaagagcaagccggcggctggaaggagtataagccattcgttatcgcaaaaaaagagcgggaaagcaaaggaattacatccttctatttgaaaccggaagacggcaagccgttacctgaattccaagcagggcaatatatcagcatcaaagtgcggattcctgattctgaatatacgcatatccgccagtacagcctgtctgatatgccgggaaaagactattatcgaatttcagtgaagaaagatggtgtcgtgtcttcctacttacacgatgggctgcaggagggagattcaatagagatcagcgcaccggcaggggactttgttttagatcatgcatcacaaaaagatctcgttttgatcagtgccggagttggcattacaccaatgatcagcatgcttaaaacatctgtttccaaacagcctgaacggcaaattctgttcattcatgcggcgaaaaacagtgaatatcatgcattgcgccatgaagtagaagaagcagcaaaacattctgctgttaaaacagcatttgtgtatcgcgagccgacagaggaagaccgtgcaggtgatctgcattttcatgaaggacagattgatcagcaattcctcaaagaactgattgccaacacagatgcggattactatatttgcggttcaccgtcgtttattacggcaatgcataagcttgtatcagagctcggatcagcgccggaatctatccattacgagctattcggtccgcaattaagtttggcgcagtccgtttgaacacatacatgaaactcttctcctttcagagaagagttttttattgagatataagaaggtagacaagcgccggtttctacatccggacaatcacagacccgccgccatttgtgcatacacggttttgctgttcttgcattgttctcagtaattcattgtttacctcaatcgctctaattagttgttccatccttagctccaaaccggccagcctgtcgattgtttgctgctggtagcccgcgggttggggagccaatggcagatcaaagggccaatgggtattcgaattctgatttttcatattgcgtattgcgcctccaatcggtgtcactttctattatgttatgttcaggcgatgtgcacgttcgcctatttagacactgatgcatagcgggcctgccacggggcacaataggctcaatatgaccagcggatggaggtaaagatcggtgttatggatggtatgggtatttttactgaagccagttatcgtattttcgattgcatatattttgtttcggcttgccggtaaaaaagctgtgtcacaaatgaacaattttgatctgcttttgaccttcgcaatcggaaccattatcagtgagccgatccttacatccaagctgccgatgtcaatttattatgcgggtgcttttttggtgctttatcttatcatgagcaagctctctttatctaataaatggcgatggctcctggtcgtgagcccgactgtcctaatccgaaacggggatattgatgaacgcggccttcgtaaagaaaggctgactgttaatgagctgcttggaaagctgagggaaaagggctatgccgacccggctgacattgatcttgctatcattgaagaaacgggagaagtaagcgtcatcccgaaagaggaagcgagagcggtgcaggtgcgggatttgaatatggaagctgaacggaattttatcccgattccgctcatactggatggcgaaatccttgatcataatttgaaatatctccaaaaaaaccgatcttggctgtttgagaagcttgaggaaaaagggtacagccccaaactgctgtcttcgattacccttggcacgatgaatgcacgcggtgatatatcccttgatttaaataccgctaatgaaccgcagcatgatccttacttatataaaccgggaaataacaattaagatggctctctcttgtaatgagagcttttttcttttttaaagggaatttttgtttggtgtcaaatgtacctagttaggaggggaactgaacatgaaggacttatccataagaaacgacatggcgccaacggtcagtttgctgtattccgcagtggaacaaaacagtctccgtctggcttccatcgtaagccatatgacacacagtgaactttactataaggggcgctgccaaacaaaaaacagcacggctcagcttttgcaccatatcacaaatgttgatatcagatgggtctggcgtatcaaggaaaatcggataccggaccatattgaacaggcatacggcccgatgacagatgaaagcggacggctgcctgaaccggtgaatcagccagacttagatgaactcctgaaaagacatcagcatgtagtagaggagttgaaatcggtatgcttcactttaactgaaaatgctttgaaccagccgctttcttttgaaggtgacaccgcgacgatacgatggggaatttggcatatggcagatcataaccgctatcatcaggcacatattgaagctctcaaaacagaatggaagcaggatgtggcgaaatatgaacgctaaaacgaagcttgtgactgatcgaattcgtttgcgctgtatggaagatcgggatcaagccactttgtttgggctgctttttaatgatcctgacgtcatgaaatattattccggtttaaaagataagaggcaaacccgcgagtgggtcaattggaaccaacgaaatgaaaaagggtacggcgttagtctgtggatcgccgaagataagcggacaggggagtttttggggcaatgcggcatcgttccccagcagatcgaaaatcaaaccgtaatggaaattggctatatgtttgcccgccgccactgggggaacggctatgcgcaagaagcggctcgggcctgtctggactatggctttaacgagcggcagttcggcaaaatgacggctttgattgatccaggtaacaaagcgtccatacgggtagcggagaaaatcggcatgcattacagcaaaacgatcagaaaatggaataaaccgatcgcggtatatgaaagaaaatcttacaattgaaagatagagctgagtttagtatcatgatatcatgtaaagttttctagggttccgcatgtcaattgacatggactggtccgagagaaaacacatacgcgtaaatagaagcgcgtatgcacacggagggaaaaaagcccggagagtcaatctcatgtgagacgactgtccggggtttttttgttttcggagaatcctaatagatagaaaggaatgactcaaaatgaaatggggattggtcgtgcttgccgctgttttcgaggttgtttgggtgataggcttaaagcacgctgactcagccttaacatggagcggcactgccatcggcatcatattcagcttttaccttctaatgaaggcgactcacagtctgcctgttggtaccgtgtatgccgtctttaccgggctcggcacagcgggaacagtacttagtgaaatcgttctctttcatgaaccggttggatggccgaagctattgttaattggcgtgctcttaatcggtgtaatcgggttgaagcttgtgacacaggatgagacagaggaaaaaggaggcgaggcataatgctgcactggatcagtttactgtgcgcgggctgtttagaaatggccggcgtggcccttatgaatcaatatgcgaaagaaaaaagcgtgaaatgggtgctgttgatcattgttggttttgccgcttcattttccttgctgtcgtacgcaatggaaaccattccgatgggaacggcttacgcggtctggacaggaattggcaccgccggcggggcgcttatcggcatcctcttttacaaggagcagaaagacgccaaacggatcttctttatcgcgttgattttatgctcagcggttggtttaaaaattctgtcataaattgatttttatcaaatcttcagtataatggataaatagtttagacttacaaagataagagggattattcatgaaatcatatatgactcagcggttggacgaataccgtgacggaaatgaggataaagggcggctcttggtcagctgccccgatcagccgggtatcgtctctgcagtttccgcgtttttatttgaacacggtgccaatattatagaatcaaatcaatatacgacagaccctgaaggcggccggttcttcctgagaatcgaattcgactgcgcaggcattcgtgagaaaaaaacatcacttcaggcggcgtttgcctctgttgcggaaaaattcgacatgacatggagcttaactttggcgagcgaactgaagcgtgtcgccattttcgtttcaaaggagctccactgcctgcatgagctgatttgggaatggcaaaccggcaacctgatggcggagatcgctgttgtcatcagtaaccatgaggaagcgagagagctggttgagcgcctgaacattccattccactatgtgaaagcgaacaaagacatcagagcggaagtcgaaaagaagcagcttaaactgctggagcagtacgatgttgatgtcatcgttctcgcacgctatatgcagattctaactcctgattttgtttcggctcatccgaatcgcatcatcaatatccaccattcattcctgccagcttttatcggtgcgaatccgtacaaacgggcctacgagcgcggcgtgaaactgatcggtgcgacatctcattatgtgacaaacgatcttgatgaagggccgatcattgaacaggatattgagcgtgtggaccaccgcgataatgcggaagcgctgaaaaacatcggaagaacaattgagcgcagcgtgcttgcccgtgctgtgaaatggcatttggaagaccgtgtcatcgttcatgaaaataaaacaatcgtctttaactagactgcaagaggcccgcgcaatgcgggctatttttgatgacaaaaaaacttgacaagtgtcttttttctttgcataatataaaaaaatcattgagcgttgaagaggattagtaagcagacctttctgtgacagagagcaaaatgaatcgctgaaacattttgccgcatgaaacctgccgaacctgccttggagtcctagggggaaaacctaggcgcataacctggcgttacaggagagcggagcgtgcacaagcgcgttcaatcaaggtggtaccacggaaacccatttcgtccttatgaatcaggatgaaatgggtttttttattgtagaagagccgcggaggagaataaatgaaaaaacaaagaatagtagtgaaaataggaagcagttcgctcacgaatagcaaaggaagcattgatgaggcaaaaatcagagagcatgttcaggcgatttccgtgttaaaaaaagcggggcatgaaatgattctgattacctcgggtgccgtagcggcggggttttccagcctcggttatccatcccgtcccgttaccatcaaaggaaaacaggcggcggccgcggtcggacaaacactgttaatgcagcaatatatgaatcaatttaaacaatactcactgactccgggacaaatccttttaacgagaaatgatttttcgaaaagagaacggtaccgaaacgcgtatgctacgataatggaattattggaacgcggcgtcattccgattatcaacgagaacgattctacgtctgttgaagaattgacattcggagataatgatatgctttctgcgttagtcagcggattgattcacgcggaccagctcatgattctcactgacattaacggactgtatgatgccaatccaaatgaaaatcctgaggcgaaacgatttgattatttgccggagatcacgcctgaattgcttggatatgcaggttcagctggatcaaaggtcggcaccggcggaatgaaatcaaagctgttggccgcacaaaccgcgctgtctctgggagtgaaagtattcattggaactggcagcggagagcaaaaacttgcggacattttggacggcaggggagacggcacttatatcggagacaaagaactatcttcggttaacaacacaaggcagtggattcagttccactcgccgatatcgggagaaattatcattgatgcgggtgccgaggaggcgatgatccataatggaagcagccttttgcccgctggcgttgtgggtgtgaacggaagctttccgaaaggggcggtcgtggaagtcaggggaccgggcggcgtgatcggcaaaggccaaacccattactcctctgaggagattatggaagccaaaggaaaacgcagtgacgaacttgattttgagaaaacgtttgaggttattcataggaatgactgggtcaatgtaaacgactaggaggcggaaaaatgagtgaagtttctgtaaaagcgaagctggcgaaagaagcagcagccgaaatgatcatgaaaacaacagccgagaaggatgaggcgctcagcctcattgcaaacggactccgcaaagaacttgattttctcttggcggagaatgcaaaagacattgagaacggaaaagagaatggtttaactccggacatcattgaccgtctcacactggctgagaaacggatacgcgatatcgcggccgcggtggagctcttaatcgacttagcggacccaatcggcgactctcttgaaacgattgaaaaagaaaacggcctgtttattgaaaaaatccgtgtgccgctcggtgtcgtaggaatgatttatgaggcgaggccaaacgtcacagttgatgcggctaccctttgcctgaagacagggaacgcggttgttctgcggggaagctcctcagccatccacagcaacaaagcgctcgtcagtgtcattcacagagcacttgagcaatcagcgcttccgattcacgctgtgcagctgattgaggatacgagcagagagacagcaaaagagctctttacgttaaatgatggcttagacgtattgattccgcgcggaggcaagaaactgattgatctcgttgtgagagaatcaacagttcctgtattagaaacgggagcaggaaactgccacatattcattgacgaaacagccaaaccgcaaatggcagaaaaggttgtcgtaaatgccaaaacgcaacgcccttccgtatgcaacgcgattgaatcattgctgattcacaaggcttgggcaagacagcacgggaaagaattgctggaccagctggaaaacgcgggagttgaaattcggggtgatgaattggtgtgtgaacttcatccttcaagcaaacaagcatcaaaagaagattgggaaaccgaatttttagcgcctgtcctcagtgtaaagacggttgaaaacgtccaagaagctgtgaagcatatccaacaatacggcaccaatcattcagaagcgattttaactgaaaatgacaaaaacgcggcatattttcaaacggctgtcgatgctgccgcggtctatcataacgcgtcaacccgctttaccgacggctttgaattcggctacggagccgaaatcggcatcagtacgcaaaagcttcatgcaagaggaccgatggggcttcctgcactgacttctacaaaatacatcattaaaggaactgggcaaatccgtgaatagcggggcaatgttcaatgaaaaagcttatctcattacgagataagcttttttatacgagaaaaattgacatttcaaatttaattgtgtacaatttaattgtataaaatgtattgggggaatgaaaaatgagtcagccattatttacagcaactgtttcagcggtaggaggaagagaaggaaaggtcatttcatcagaccgcgttcttgagcttgatgtcgcaatgccggggacaccgagagccaagaaattagaaaaagcgacaaatccagagcagctgtttgcagcaggttatgcagcttgctttgacagcgccctgcagcttgtcgcaagaacagaacgggtaaaagtagagacagaggttacagcgaatgttagcctgttaaaggatgaagcggaccagggctataagctgggtgtgacgctgcaagtaaaaggagaaggagtcagtgcatcagaattggaggcgcttgtgaaaaaagcgcacggcgtctgcccgtattcaaaagcaacctccggaaatattgatgtgacacttgaagttgctgaataaataaaaagaggatgcctgtacaaggcatcctcaatttttttgatgaagtgtttccagcaatgtatatagagcggattttaactgtttgagatcctccccagactgctttgagagccccagaattgtctctggaatgtcaaccgctttttcttttaataacgctccgtcctctgtcaggctgatcaacacggaccgctcatcctcttcagatctttttctcgtaatcaaaccctgttgttccattcgtttaagcatcggagtgagcgttcctgaatctaaatacagctgttcgcccatttttttgacagtaagcgtttcatgttcccataacaaaagcaaagccaaatattgagggtatgttatattcagcttatcaagcagcggcttgtattgctttgtcatttcccgcgaactcgcatatagcaaaaaacaaagctgattctccaatttcatatgatcaaatttattttccattttgttcaccaactcttttttgtcattcgattctattgtatctgaaaaacctcacttttcctattctcggcaaacatagcatgtttaaaaagatcagaaagggaaatataacaactagatacaaataaggaggttgggaaatatggcactatttacagcaaaagtaaccgcgcgaggcggacgagcaggacatattacatcagatgacggtgttcttgattttgatattgtcatgccaaatgccaaaaaagaaggacaaaccggcacaaatccggaacagctctttgcggcagggtatgctgcatgcttcggcggcgcgctcgaacacgtagccaaagagcagaatatcgaaattgattcggagattgaagggcaggtcagcctcatgaaggatgagagcgacggcgggtttaaaatcggtgtcacacttgttgtgaacacgaaagatttagatcgggaaaaggcacaagagcttgtcaacgccgctcatgaattctgtccttactcaaaggcaaccagaggaaatgttgatgtaaaactagaattaaaataatgaccggcatcctgagtgttctcaggatgttttttggtgtcggagcgggtgtgatcttttcgaggtctgagacatttctaataaatgatttagacttatatccattatgaattgacgcggaacggggtaggagtgggcacagattattgataaaacgtcagagaagcgatcacagcgtttaaagcctgcaaaagttacagatggagcgggcgactggctcggtgtctgccaagctgaattccggcgcgcatgattgctgttttgtatttgcacagggcatagcgctacttggagaaataacaaggaccaggccgcgcatgcctgatccttttaatttttaatattctttcttattggcgaagttccgccatgcttgaaacggggataaatgctctgttagtgtcacttgataaaaggggatcgttctttcttcagcaggtttatcaatttctttataaatgaatgaatcatcaaacccggcttcggcagcgtctgtgtgctcagctgcatagaaaacggctttaggccgggcccagtagatggcgcccaagcacattgggcatggttcacagctcgtatacaaaatgcagtcatcaagctggtaggctcctagcaccttacaggctttccgaatagctgtgacttccgcgtgggcagtcggatcattgcttgttgtgacgttgttgtttccctctgcaataatggctccgtctttcacgataacggctccaaaaggcccgccgattcctgcattcactccttcacatgcgagagtgacagcccgttttaagaacgtttcatgattcatcccaatccctcctgtcaatagagtgttattagtatagccgaaaagaatgcaaagaacattcttaaaaaagtgcaaaataaacaaagtatttgggggatttgctaaaataagaaactattgtggctgtattatagaaaaaaaccatctgccaaatgcagatggttttttcaaattatactagctgtgtctgctgtgctcttgcctgttttgcagcttcaaccatgtttttcaatgctgcaaccgtttcttcctgctgtcttgttttcaatccgcagtctggatttacccagaagcggtcagtcggacagacggcaagcgcatcaacgataatattgtacatttcttcagttgacggcacacgagggctgtgaatgtcatatacaccaaggccaagccctttcaaatacgggtggttttttaagtaatctaaaaatcctccgtggcttctgctatgttcgattgtaatcacatcggcatcaagatcattgattgtatcaacgatatcttcgaagttgctgtagcacatatgtgtatgaatttgtgtctcgtttttcacggaagaagtggttaatctgaaagcttctgccgcccaagtcaaatactcatcccaatcgcgggtttttaatggaaggccttcacgcagcgctggttcatcgacttgaatgatttgaatgcctgcgtcttcaagcgctttaacttctttgcgaagggcaagcccgatttggaaggcgatttctttcctcgagatgtcgtttcgagggaaagaccagtttaagattgtaaccgggcccgtcagcattccttttacatgcttggaagtcaatgactgtgcgtagactgtgtctttcactgtcatcggttcaataaattcaacatctccgtaaatgactggcgggcggacacagcgtgagccgtatgattgaacccaggcatatttagtgaaggcgaaaccggccagcttttcaccaaagtattcgaccatgtctgtccgttcaaattcgccgtgaacaaggacatcaagctccaattcttcctgaatatcaatccatctttttgtttccgcattgataaagttttgatactgttcatcggaccactcagctttccgccatttttggcgtgcgctccgcacttcagcagactgcgggaagctgccgatcgttgtcgtcggcaaaagcggaaggccgagagattcattttgcagggctaaacgttcttcaaacggaatcgggcgcttgaagtctttatcagttaattgctcaagctctttcttttgttcagaattggcgcctgttgcaaactgcttaagcgcctggatatcagccttagcctgctgaatctcttcgctgatcgccgcttttcctgatactaagccttctttcaaagctgtcagctcggccagcttttcttttgcgtaggataatccgttcaataggtctttttccaaatgctcatcagggtgtttcgctactggaacatgcagcaggctgctggaaggctgaatccacagttcatcaacttttgcaatgctgagaatatcaagaacggcatcgagacgctcttcaaggtccgctttccaaatgttgcgtccgtcgataacgccggctgccagcactttgtctgtcggaaagccatgtgttttaagctgttccaggtttctgcctttgtcgtgaacgaaatcaaggccaattccctgaaccgggtaagaaatcagctcttcataagcatcaacagaatcaaaatacgtctgcaaaagcacattcaaggatgaaagctcacttgtaatgctttcaaataattcttttgcaccgcggacatcttcactagaggcggtaacgagcgccggctcatcgatttgaacccattttacgccttcttcttcaagctctttcaaaagctgtacatataatggcacaaggcgtttttggatcgcttttgcttcagacggttcatagcctttagcaagcgtaacgaacgtataagggccgacaatcacaggctttgtttccacaccgtattcctgtttgatccggcgataatcttcgagttgtttgtttcttgtcagacggaactcaatgctctcgtcatattccggaacgatgtaatggtaatttgtattaaaccattttgtcatttcactagatacggcgtctttgattccgcgggcgatagcgaagtatgtatcggtagcatcagtcaaatgtctgaaacgtttcgggatccagttgaagctgactgctgtgtcgagtacatggtcatactgtgtgaaatcagaaacaggcacaacatcaatctgttggtcaatttgtgtttttactgcggataaaaaaagttcgtcgatttgcttcaaaaacgtatctttatcagtactgcctttccaatacgcttcaagtgcttttttccattcccggttcagtccgattctcggaaatcctaaattcgatgttttgatggttgtcattgtttctcctcctttatatgtaaaacactctcgttaacccgcggatacaggctcctaagaggttttctcacaacaaaaagcctctttcccatgagagaaagaggcttttctacgtaaaacactgcctctctcatctctcagacacaatctgatggaattagcaccgtgccttatgagacatcagtctcggcgcgaaaagcagtgcgccccatttcacaatggtattacggtcggttgctgttggggtcaaaaggccaatccctcgcccaactctcgataagagaaaatgttattaattttttgaaaagttgaatcatttgttggtaatcttaacagtaattcaaattcattgtcaacatagaatttgaaatttttatttacatgatgtggtgtatattatataagaaaaataatcttatagggtcaacaaatgtgattgctctgctttttctgcgagctcatcaggagctgttaaatacaggaatccatttcctgccagcgtttttgcaatatcaagaggaagtgtcctgcggattagctgtgcgaaaacctcagattcagaaagctttctttgaaatgattcttcttcatagcttttgattaaagcaagcgcaccgctgacatgaggggcagccattgaagtgccggtcagcttaccgtacttcttgttgggaagggtggataagatgttttctcctggtgccacaaggtcaatctctttattcgcgttagaaaattctgataattctcgcgctacagaaacagatccaactgcaatcacttcattataagctgcggggtaggaaagctcttctgtgcgttcgtcgccgtcaccttcatttcccgctgcacaaacgacaagcactccgtttttcactgcgtttttcactgcttcttttagctctggcacatcgcttggccctccaagggacattgagatgatgtcgactttctgttccaccgcgtagttgatgccgttaattatccattcgtattgtccgctgccgttctcgccgccaagaaccttcacaatcaataggcttgcctcaggcgcgactccggcaatgcctccgtttgaatcattagctgcaattgttccggcgacgtgtgtgccgtgtccgttgtagtcggaaatcgcatcttccttgccgccgtcgtcatccgtgaagttctttccgccgatgatttgattttttaaatcagggtggcttgtgtcgcagcccgtgtctaatacagcaactttaatatttttgccttttaccccttttgcccacatttctggcgccttaatcactttaatgccctcaggaagctcgtttacatccatgatctgctcattcgtcacatacgggatcaagcggatttcaccattcataaaaaagccctccttttttatgcttgcaagtggattcaagggtgttgcctcatattatatgaaaaaagcaagcgctcggacagagccatttgaagcattttgaaaaaataggatacacaccaaagaattagtaatcttcaaaatattggatggcttcaacatgtatgactgggattcaactgtaagtcaagttataatagtgttggggaaaggagcagtgtcatgaaactgaatgaaaaattatatgcatttttttcagagcatgtggaacaaatggccgaggaatggattgaaacgatggaggaaagtgatccgaattcgctttacgccctacataatgcaacagtaacggaagaattgaaagagcaggacagagagttttaccggcatctgaattacatgtatgttttaccggaaaaacaatttctcgaagagtttcaagagtgggtcattgagctgaccaacgatcaaaaacatctcgacacaccggttcagtatgtcattcgggagtttatgagaaacaggagattatatacgaagtattttgagaagttcgcagaagaaaatgaatcagcgtttgaaccgggagagaagcaaaaatgggcagatttgattgtaaaagtatttgatttcaccatttatacattcgttgatcacgctgaaatgaatgccaagcagcaattaaacgcccaaagagaaatgatattggaattaagctcacctgtcattaccctgagcaaatcaacagctctgctgccgcttgtcggtgacattgataccgaacgggcgaagtttattctggaaaacacgcttcaagcttgtgcgaaaagacgtgtggagcatctgttaatcgatctgtcaggtgttgttgtggtggatacgatggtggcgcaccagatctttaaattgattgaggcgcttaatctgatcggtgtccggtcaaccctgtcaggaatcaggcctgaaattgcgcaaactgctgtacagctggggattgacttttcgaatattaccattaaaaccaaccttgcccaagcattaaactatcatcaataaaaaaatccgctatctgtgatagcggattttttatgatgcgaaacataaagatacgagaaaggatcccgcgaataataagaggacgaggcaaaagaacacccagtcgcgccggttcacgctcaatgtcctgtagtatgtccggtttctgcttcctgtaaatcctttcgattccatcgcaagcgctgtccgttccgcttttctgatggcgcttgccaatagcggtatggtatatcgttttaacgcactgattttattaatgatgccgctctccgccgctcctcctctgattttatgagcctgctgaatcagctggacctcatcctttaacagcggaagaaagcgaaagcctgcaatgacaccgtacgcgagctttggtgagagcctgcactgctggacaaggctcagcataaatagaatcggatcggttgtaaaaacaaacatcatcgataaggcggaaaagcataaaatacgaaacccgagagagatgccgacagacacattatcgctgttaatggagatagggcctgcttgaaacaaaaaattatccggtgttgtcggcacttttccaaaaactgcggctgtccacacgcatccgaatgctaaaatcaaaaacggaatcgtaaacaacaaccattttttcaatgggattccggccgccagtaaaacgcccgcaacgatgatgatataaaaacatgccggagtgtaagggttgtaaataaacgacagcatgacgacacaacaaaaaaccgccgccgctttcacagtcggattaatgagatgtaacggctgcttcatcacgcacctcctcttgaaatgccatccattcatatagaaggggaagggtgagctttgctttttgaacaagccctgtttcttgagaaaacaactgcgctggagatccgtcaaaggccaggcctgtatcgtgaagcacaagcacgctgtcagcatacgaagagactagctccatatcgtgtgtaatcataaggacagcagttccctctgccttgatacgttgaatcatttccatgcattcagccgccgtgcgggcatcctggccaaaggttggttcgtctaataataaaacctttacgtcatgcatgagcatagtagctacgctcagtcgccgtttttgcccttggctgatcgcaaacggatgatgatcagccaaatgcgcaagaccaaaacgctgcagcaggtgttgcgcttttttctcagtttcagcatttgctttctggccgaacagaagctcgtcatacaccgtatcggtgacgaattgatgctcagggttttgaaaaacaaatcccatccgtttacgcaattctttttctttatatttctgcagcggctgatcatagagaaggattttgccgctttgcggtttcatgagacgggccagaactgataggagcgtcgattttccagttccgttcggaccgacaagcgccgttaaagagccttcgcgcaacgaaaagctgatgtctttgaaaatcgcctgctgtcctctcgcgaacgaaaggctgctgacttcaagcacactctccccagaaggggctttcttctttttgacatgcccggcaggaataggctctttgaacagcatctcttttgataaagtaaacggcatactcagcttttcctgcagatgacagacctttggaatggcgatgcccaatttctttagtgtctccgcttcatgctgaaatagatttttcgtcaggccatccagtgcctttttgcctgatttgtcgagtacgatcgttctctcaatccaaggcgcccattcatcaagctggtgctcaatgacgaggaggctgaaacctttttcccgctgaagatccttcatcagatgaacgaactcccgagctgagaaagggtctaaaagagaggtcggctcatctaaaataataagctcaggctccatcgccaaaatacaggcgagagccactttctgcttttgtcctcctgaaagggttgagatcattttttcttttaaatgggtaatgcgtaatttttctaatacggcgttgattttctctgtcatttcttcttttggaatttgcagattttccagcccgaacgctatttcgtcctccaccgtcagcatgcagaactgctgatcaggatcctgaaaaacgaccccggcatgctgagtaatcgtttcggaggtttcagcatctgtgaccggcttttgaaatagaaatacatgtccggactgaatgccgtcgcaagcctccggatatagaccgtttaaacaaagggcgagcgagcttttaccgcatccgctcggtcctaataataaaacacattctcctttttgaagctcaaacgaaatgtcttgaaaaaccggtttctcgtcttcttcataagagaagctgagctgctcaaccgtcagaagctcatcaaaggcttgcatgttctgacgcccgcttccgtttctttttcagttcctttccgagtgccattccgtttaacacacctgtataagcgagagagtcgctgacagcttttccgagaagccccgccaaaagcgcgccggaaatgaggcggatcacaagcataatgagcagataacctggtgaataggctgcatagccagaaacaaagagatcatagataaagctggctactgaagaccccataccggccagcataaggacagggagagagtatgctttccagcgtgttgcaagaaatacagcctcagccccgagcccttgaacaatgccaatgacgatgaccatcgggccagacggatttcccagcaggcactcaacgagagcggcaatgatttcagaaacgagcgccgcacccggttttcgaatcatgtacgcggcgatcacagaaacgataaaccaaatgccgtaaattggttcataggcgattggcccaaacatacctgcaagtacgtttccgaaatgtgtaaataataaataaacaacggcaaatacgatactgataacggacatgatgacaatttcttttactttccagcttttcatgttatccctgctttctgttttttcttgatggactgttagccgaaagattcacagtcatggtgatgtggtttgtttgctgctcagccatgcggaaaacggcctccaatgtgctgaatacgtcatgcgcatccccgtcaagctcgctcgcgtaatggacaccctgtacgaaagtgccttgggcttttgcaatgtcgacagcctccataatcaatcccatataatccggctcattcattggataaagggcaaattggcacggcgcttccgccttcaagcctcggacagcatcttcattgacacgcttatcacctttggaaagatatgtatccccctgtgtgtcacccgggcatccaatggaaaacgtgccgttcatgacgatgtgttgttcgctgtttgctgcatgaagttaaatggcttttgcagcatcgaatacatgatcaatcgatccgcgtaacaccgtgctgatatggtcggttttcgtccataccttggatgtatctgtttttttcagcgcagacttgatcacactgataaaatcatccgtcatcggatataaagagaagcgaaaaccggcgattctgcttgtaccgcaaatatgctccatttctccgacctcctgtttttttggtaaaataaaaaactgcatatcctaagggaatatgcagtcatagatcgattaagcgcacaaaaaaatacaccattcggtcaacctgcacttccccacgctggtattatccagatcgggtcataagggatcaaaacgcgattctcccgcgttttatctcagccaaaacagcacccctagtgctttccgtatacaattttttattttgacatcataatagatgataagaatcattttgtaaacaacgaaatcatttttttcatatagggacaggagaggatgatcacatttggacaaaggacacatattaattgtggaagatgaagaaaaaatcgccagggttcttcagcttgaattggaatatgaaggatacagcgtcacgatcaaacacaatggcacagaaggtcttgatgcggcagcggaaggcgggtattccttggtgcttcttgatgttatgcttccggggcttagcggactggaagtgctgcgccgcttgagaaaaacggattcgcagacaccggtcatattattaacggcgcgagacagtattcctgataaggtaacaggtctggacatcggtgcgaatgactatgtcaccaagccgtttgaaatcgaggaattgcttgcgagaatcagggcggcgctgcgacaaaatggaacaaaaactgaagatatcggcacctttcttacatatgacgatttgcgggtgaacgaaaaaacccgtgaagtgagacgcggagacaaagaggtggaattaacgccgcgggaatttgatctgctcgtctatatgctaaagcatccgcagcaagtgctgacacgggagcaaattctaagctcggtatggggatttgattatatcggtgatacaaatgtcgtggacgtctacataagatacatcagaaaaaaactggactatccttacgaaaaacagctgatccatacgattcgaggggtcggctatgccattaaggggtaaacgatgaagctgaagaccaagattcatctatacacttcgatatcactgttgattttattaattttggttcataccgcagtctatctcattttttcgtctgcgctgacatcaaaggatgcggcccggcttgctgatgagacggataacattgccgaagcgctgcgtgccgctgaaacagaaggagtggctttgcaggatatgctgcaggcctatcttccggcaaatggcatggtgcgtgtagtgaatggtgatcaaaaagccgttatgacgatcacaaaagaaaaagcctataaagattttcctctctcttttcatagcggcgaaacggcagatgtgaggaaacatgacggcaagctgtttgccgaggctgctgttccggtgatttggaccgatggacaagtggtgtctcttcagctggttgaaaggctggagaacacagaagagagtctgtttctgctgaaaatcatcttaatcgctgcaagtgctgctgtctgcattgcttctttttttgcaggcagcttgcttgcccgccgtatcatcaatccgatcagacgattaatgatcacaatgaaagacatacagcgagacaaagaatttaaaacgatttctttagaaggacagtccaacgatgaattgtatcaaatggggctgacatttaatgaaatggcaatgatgctgaaggagcactatgataaacagcagcaatttgttcaagatgcttcacacgaattgaaaaccccgctcactattatagaaagctacagcagtctgatgaagcggtggggggcaaaaaagccggaggtgcttgaggagtcgatagaagccattcactcagaagcggtgcatatgaaaaaactgaccaatcagcttttggcgctggccaaaagccatcaaggactcgaggttgatctgaaaacaatcgatctgattgaagcggcgcgcgcggttatgcaaacgctccagtccgtttatcagcgtgacatattgcttgaaacagataaagagagcctgcttgtaaaggctgatgaagaacgcatcaagcagctgttgaccattttgcttgataatgcaataaagtatagtgaaaagcctattgagatgtcagccggaacgaggaatggacggccatttctatcagtgagggatgaaggcatcggaatacctgaggagcatatcccgcatttgttcgaacggttctaccgggcagatgaggcacgaaacagaaaaacaggcggaacgggtttaggcctttccattgccaagcaaatcgctgatgagcatggcattgagctgtctgtcaaaagcaagccgggacaaggaacagctgtcaccatgcaattcagcgaacagaatgggggaggccgatgactaaaacaataaaaacagtatcttttgctgcagcagccattttagttgtcatcatctgtacgtttctcatcattcggcaaacccatgagaacgtattgtcaaaggaggctgtcgtaaaaaaagtcgaagcctcttatgaaggcaaggtcacgaaagcaacacaatcaaaggataaaaaaacatatgatataacccttgaaaatccaaagggaacttactttgtaaaagcagacgcaatatcggctgacattctttcaatgaatagagtaaaagcagtgaatccatctgccatgacagaaaaagatgccgagcatctcgcgcttgagcgggtgccgggaacggtcaaaaaacaaacacggcaaagtcaagttgccacttataccatacaaaaagaagacgggaaaacatacgaagtgaaggtagacatgcaggcaaaaacagtcttgtctgccgatcaaatcagcagcaaagatcaacaaaaaacgccgattacgaaaaaagaagccaaaacaattgcagagcgaaaaacgggcggaacagcggatgacgcagatctcgaagaaagtgagggcactctcatctttgaagtagacgttgatcttcctgataataaggaagcgacagtgaaaatcaatgcctacacaggaaaggtagctaacattgtgtatgaagactgacggtttctcatcaaattctcatcttgctctcgttttcctttcatgttgagtgtgtaaactgtactcatacaaaacaaaggaggactcacaaatgctcaagaaaaaatggatggtcggtcttttagcagggtgcctagcggccggaggattcagctacaacgcgtttgccaaagaaaacaatgaaaacagacaggcttcttctaagacggatgcactcactgaacaagaagcagaagcaattgctaaaacagttgttgacggcacagtagaagacattgacagagacctttacaacggcaaagaagtctatgaagtggagattgaaaaagaaggtgaagactacgacgtttatgtagatattcatacaaaacaagcgcttaatgacccgctaaaggagaaagcagaacaagtcgccataaccaaagaagaagctgaagaaattgctttaaagcaaacaggcggaaccgtaacagaaagtaagcttgacgaagatgacggtgcttacatctatgaaatggaaatccaaacgaaacaaggaactgagacagaatttgaaatttccgcaaaagatggacgcattatcaaacaggagatagatgactaatcaaaacccccgctgcagcgggggtttttcatgataagaaaccttcttttggacaatctaagtagaaaaggaggcgaaacgcatggaaaagaaagaggagcaatacatcaatcaggctgaatatgtccctcatccgacgaaggaaggagagtatgccttatttcttcatgaaacgtatcatctgctttctgaagatgacgagacacaaacaacagaataagggcttaggcccttgttttgttccgtaattgtgatgtaagcgtatttattacttttttgagttgacacagcttgtttttttctgtaatctcagtgtgtcaattcaattaggaacttcgttaggtgaggctcctgtatggagatacgctgctgcccaaaaatgtccaaagacgccaatgggtcaacagaaatcatcgacataaggtgatttttaatgcagctggatgcttgtcctatgccatacagtgctaaagctctacgattgaaggcgcccgcacgctttttttgccgtgcttctttcaccttcaatcccgaaggctttttttatgcctttaaaacgaaaccaatcaaaggaggtgcggagtatggattctccccattcgagtcaatctgaagaagtacccatatactatgacagcaagacaattgattacacgatgaggagacgaactgccgcaccttctggcgaggccggcacgtctccgtagaggaggtacgagtcccgatggttcaaaacatgacctatgacgaactcattttacgcatcattattttactgcgagacgggaaaatcagggatttcagaagtgttattgatgagcttcagccctatgacatggcatttatttttaaagaaatgccggaaaaacaccgcgcccgctatttatcttatttaactgtagacgatatcactgatatgatcggggagctggaacgcgaatttcagcttgtcgtcttaaataaagtcggaaaaacaaaagcaacactggcgatgaacaaaatggacaacgatgacctcgctcaattgcttgaagaaatggacgaagaactgaaggaacagcttttgtccagcatggaagcgtcagaatcaaaagctgtacagctcttaatgaattacccggctgattcagcgggacgcatgatgacaaaccggtatgtgtggattcctcagcattacacggtaaaagacgcggtcgtcaaactgaaaagcttcgctgaaatagctgaatcgatcaactacttatatgttattaatgaaagcaaacagctggttggggttctttcctaccgcgatttaattctgggtgaacctgaagaaaaggtgcaggatttaatgtttacccgcgtcatctcagcagatgctcttcaggaccaggaagaagttgcccgcctgatagaacgttacgattttttggcaataccggttgtagaagaaaacaacgtgcttgtcggtattgtgacggtcgatgatattatcgacgtcgttattcgggaagctgatgaggattacgaaaaatttgccgcttccggtaaagacatcacctttgacacaaaagcttacgtggcggcataccggcgcctgccatggctgattttactcttgtttatcggactgatttcaggaagcattatcagctattttgaagatgcgctgaagcaggttgtcgcgcttgcgtttttcatgccgatggtgtcagggatgacaggaaatacgggaacacaatctctcgcggttgtcatcagaggtttgtctaaagaagaaatgaacaaaaaaacgattgtgcgcctgatcttccgggagttcagaacaagcatttttatcggagcggtttgttctgtgctgattgcgattgtctccatcatatggcaggggaatgcgcttttgggatttgttgtcgcctcttcactgttcttaaccttaatcatcggcacgatgtcaggaacgattatccctattattttgcacaaactgaaagtagacccggcgattgcttctggaccgctgattacaacgttaaacgatattttatctttattaatctactttggcattgccactgcattcattcactcattataaacgtaaaaagtccgtctcaactgcgagccggacttttattatttaacggtttttgtaccgaaagtgagcattaagctgcccctccagcatttttttccgcacttgcggatcgttttttaacatctgttcttttttgcgcatatcctttaaaatctctgccgtctgtacgccgtcttcacgcttattggcgatatccatcagccgctccacatcggcaaaagagtattttcttgtcccccttgaagaacgctgcgggtaaatgagctttcgttcctcataatacctgatctgtcttacggacaatcctgtcaattcactcacaattccgattgaaatcacttttttgtctttataagaatgatcttctgtggtcatttttccacccctggatgtcttttgataatagtatataaaaaacaaagagaaaaaacctgacgcttgtcatattttctaacatcaaatagaagatttttgaaaaaatacggaagaaaaattaacaagaataatgcgtaacacccaagcgcgttttatcctttatgtaacgaatcaaacgaggaggaaggataatcatggaggaagaaaaagcggtctcactggcaaaagaaattatagagttggatatcaagcgtgatgaaatgctggagacgtttatgcagcttgccggagaacaggcttttcaattattaagatcggttcaaaacggacaataccgaaaatcttcgtaaacataaattctttacattagattcataccacgttcatttaaaaagagtatcttttgtataggatacctcaaaatgaaggaggacgctatgagtaatttattgaaatccgctttagaaaaagaacgacgccattattctgaaaaactctatcagattggggtttataataaagaggtcatgaacaaaatgacgatttctgagcttcggaaagaatacgcttatttctttcgaagcattacaaatcataaaaattatccttatacaagataatgtataaggatttttttgcttttagaaggaatttctcgaattatagcgaatacgtatagtaagggactgaactcttattatatgtaagggttttcattatttttttataaaaatcctatatacgaggtagatatgatgagattatcgtttaacgaagaagaagttgagcgtgcgatgaatttgtacagagtttttgcaagggctttcaaaagtgtgtccgaacatagtatccgtgatagcaaagagcacggttttaatcccactgaatttgctgtactggagctcctgtacacaagaggcccgcaaaaattacagcaaattgggtcgagacttctgcttgtaagcggaaacgtcacatatgttattgacaaactagaaagaaacgggtttttagtaagggagcaggacccaaaagataaacgctctgtttacgcacatttaactgacaagggaaatgagtatttggataaaatttatccgattcatgcactgcgtattgcgagagcgttttcaggtctttcgcctgatgaacaggaccagctgatcgtcctgctcaagaaagcaggcatacacagccagcatttgctgtttcgttaactattctacactctctatttcaggagagtgtttttttgtttccatatgattctttttaaaacatcttcaatcttcctatcagacatttcgccaaggtatccattgacgtgttttttatactccttcatctgttcgttcgattgaaaaaataccgcgatatactcttctgctttctgcatgtcccagtttctcatatctgtgacgagcttcctttcatgtagaaggtttaaattcatttcctcctgtcccggcagtgcatgataaataaataccggaagccgtttctgtaagcattcactgatggtcacgcctccgggtttagtcatgatgcctgtcgcctgttcgtacaaacggttcatctctgctttgctgtgaaggtaaggaatcgcctcaatcaaggggtggtgtaaacttttgacataggagtagagcttttcgtttctgccgcataatattttgtataagatctttccgcctggcgacagttcctgcacccattttaaaatcccaccgacccccatactgccccctgtgatgatgatggtatatggcgggtggtgctgcaaggtatctgctgattccatttcaaaatttcggtgaactggaatgccggtcaagtatatgttgttctgatcgatcccctctgatattagctgcttctttacttccgtgctcggaacaaaatggtaatcaatgttcttccgtccccataattgattcacgaaaaaatcagtgtatacattcacaaccgtcagattcggatattcaggctttaatcggttcagcagataagaaggcagcgcatgtgtgcagaaggcgatatcaggctgtttttcttggaggatgtgcctcatttgctgtgtgaacagccattcgtacatgaaatagcgtttgtcatgctgaaattctccgcaggcgaggagcctgtaaatgccgctgtacgttttcgggaaatattgaatccattttaaataagccacggaggacaatttttctaaccggctatacgcatgtgaaaagatatcaatcttttcagctgccagcccttgagactctaattcagcctgcaatgcatcagccacatgatgatggccggtggaaatgcttaaaaaaggaaaaatgagaatgtttttcatgacggtcctcctaaaaaatatggcaactatattttgaggagaacgttcacaaaatataagggtgtttttgatcataaggaaggtgaaaagatgaaaacttgtttcctttccatatggagagtggttgacccgatttatttctttttttcaaggctgaccttggttgacaaagatcgtaaaagcgtctttcgagtcaggctgacgaagtacaaaggacatcatgtcgtgcttagcgacggaacgcatataagaaaaaatgatgtgctcgttaaaatccacctgcataacataaagctgatcagggagcttcaaagcattgagagcgcagtcagaaagggaatcattatttatcagaaagtatatcaatcgatgccgcttcttcttgactatattaacaatcataaaaaaagcgagaaaatcaaaggaatcattgggattacaatgcttgacaaaggtgtggaaaggctcggctttgatgtgatcaccccggtgaatcctttttacagatgttttaaaaaagtgtcccatgtgccgattttatatttgacttcaaagcctgtgagcttgcggcatttaccgaattcatcctatttgtttatctcaaaagaaaagctgcagaaaacctatcaaaaaaaagactgatgcctcggtcagcacagtcttttttgattaaatctgatgaaatgtcacttcaggacggcttccgacacggatatttacgccggtttgtcccaagccctcgctgatataaaatggtttatcgtgatgataatgaagacctttaatcatgttcattcgcacgagctttcccattttcaccaaatgatacggttttggccagtgaatttgcccgccgtgaaaatgccctgacagcaggtaatcataatgaacatctttcatatccagaataatatttgggtcatgtgttaagacaagatgatagccattttccagactttgataagagccgttgatattactccgattcgtactgtaatcatcaatgccaataatattgactggccctgcagccgtctcgattcgaacatgttcattttgcagcgtgatacagccgttttcctctaaaactcgcttcaatctccgaaagtcctcttctttcaatacataatcgtggttaccgaacaccgcgtacattccatatgcaggctttagcttttgcaaggcgttcaagtaacctgccagcttcggaatattacgtttccgatcaagaaaatccccggtaagagcaatgatgtccacaggctgatcttttgttaaatgatacagctcctcaggtgagactgaaatgttttccaagtgaagatcagataaatgaaggatatttaatttttttctggctggaaggccgtctttttggtcgattgaaatggtgttgactttcacatcttttgtattgcggttcgctttatatagaaatggcacaaatacgagtatggccaatgaaagtaagattgtaaacaaaatatatcccctcccttctatcagtatagtaagtgatcaagccctatggatagcgggaattaatgggtagagacaggttgaaaaacggattgtcatatgatgaatgatttggaagggaaaagggataataaattttgacacatgaggcagaacatgccgacggagtcagaataacaaatggatgtgtaagcaatgttacgattgatgagacaacaaaaaaagaaacatattatctctggatcgcattatttcttcttttattgtatgtatccccgctttttattttaaaggaagatgcccatatccgggtccacgataatttagattccaacatcgcttggtacaaggttctggccgatagcggagaaatcgtcggcaaggttgacgctgccattccgcaaatcattaacgggctgccccgggatgcctttggcaccgagtggagcggaattgtttggctccatgctttcttttcttccatgaccgcctatgcaataagccagacggttacaagagttgtcgctttttttggaatgtatgtgctgctgaagaaacatataattccggaaccaaaagcggctttcatccgaattggcgtatcgcttgcatttgccttaacaccgttctggccttcgggaatgctgagtacgcttgggtaccctttggcactgtgggcttttttaaatatccgaaaaggggatatctcatggagagagtggctgacgctgggcttgctccctctatactcaagctttgttctaggcttcttctttttcctggcagggatggcgtgtttttggctgtatgatgccattacaaaaagaagatggaatttgatgttcttaggcagtattgcatttatgacgagtatctatcttttcgttgaatatcggcttgtctattcgatgctgtttgaacacgcaccgatgcatcgtatcgaatttatctcatccaggcatgacgtttggcattctcttcggctatccgtaaaaaactttgtctatggtcataatcatgtgatgaccgttcataccgttgtcatccttccgatcctgctggtcgtatttgctgctctgctgttcaaacgaaatcggacagagccagaaaatgtttatctgtttttatgtgtgcttaattacggattgtcattatggtatgcgttttggttcaacaaaatttgggctgttccaaagcagaaatttgcctttttagcagaatttaattttgcccgttttcattttcttcggccgcttgttatatacgtgagctttgcgcttgctttatatctcatttggcggatggggaaaggatggaaatggcttgtgtacgccgcagtcgctgcacagctgatggtgttggcgccttttaatgaagaatatacgtatggcgttcattacaacgcgccgacattcaaggagttttatgcatcggagcaattcaaagagattaaggaatatatcggacgtccgcaggattcgtacagggtggcgagcatcggactgcatccgtctatcgcccaatataacgggttttatacgttagatacgtataacaatctgtatccgctttcatataaatatgaatttaggaaaatcatcgaaaaagagctggaaaaaaattctcggctgaaacaatactttgatgaatggggcagccgctgctacctttttgtcgatgaactcggtaaacgatatgatttcaaaaagaactcgaagaaaacgatcaacaaccttcaattaaatacagatgtatttaaaaaaatgggcggacggtacattttttcttcagttccgatcatgaatgctgaacaaaaccatctcgcgctcgtaaagacgtttgaccataaagattccgcctggcgcatttatttatatgaaacaagataaggaggatatcgattgaaacagtcacagccagtattaaccatcgtcgtcccgtgtttcaatgaagaggaagtgtttcaagaaacaagccgtcagctgacagaggttgtagatgatttaattgaagaaaaattaattgctgaagacagtaaaattctgtttgtcgatgatggcagcaaagaccgcacttgggctttaattgctatggagagcataagaaacaagaaggttaccggcttaaaattagcctgcaatgtcggccaccaaaaagcgcttttagccggactgcataaagcgaagaataggtcagactgcgtcatttcgatcgatgctgatcttcaggacgacatctctgtgatccgggattttatgctgaaatatcatgagggctgcgagatcgtttacggtgtacgccggagcagaaaaaccgatacctttttcaagcgcacgacagcgttagggttttatcgtctcatgaataagcttgggattaaattaatttataatcatgctgattttcgtttaatgaataaaaggtcccttgaagagcttgagcgttatccggaagcgaatctgtttttaagaggtattgtccccatgatcggctttaaatcggccgaagttttgtatgaccgcaaggaacgctttgccggcaaaacgaaatatccgctgaaaaagatgctatccttcgcttttaacgggattacttcattcagtgtcgcaccaattcgattctttacgcttttagggtttgttttgtttttcctcagcgctgtggcagggattggcgcgtttattcaaaagctgctcggccatacgaatgcaggctgggcgtctctcatcatatccatttggtttttgggcgggctgcaattgatgggaattggcatcatcggagagtatattggaacgattttttctgaagtgaaaagacgaccgaaatacgcgatcgatattgatttgtataatgagcagctgagcccgcttcagcgccaggaaaaagagcggttagaaaaaaagtacagttaaacacggaaagagctgacttcattagtcagctctttttcttcaactgatgcaatatggcgctaagcggttcgtcttgcgggttgcggtaaaaatcaaaaaatgggcagccctgctttttaattcgatcgatgaccgtatcaattgtaaacagagcgggtgttaaagatgattgcacctcatgccagtagagcggggctgcaacagtcccaagctcatttcctctcgtcgaatagggacagataatcgtttttccttctgcatgctgcaaataatcaagatacaatttgccgtgtctgtttttaatcaagcgttcagtggtaaatagctcgggaaatgcattggtgcagtactctgcgatcagctgcgtaaattggcgtgtttcttcatacgtaaatgcctcgggagacaagggaatataaagctggatgcctttgttgccggacagcttcgggtacgatgtgatgccaaaggaatccaacagccgcttcagttcatttgcggcctgcacggccataagaaagtcatctcgcgaaggcgggtctaaatcaatgacaatctcagccggacgcctgcttttaatggtttgaaaaggaacgtgaaactccaaagcaagctggttgcaaagccatagcaatgtagacatatcctcacagacaatatgttcatggctcccatcatagaaagattgaacaaaatccggcgcatagtccggcttgtttttttggaaaaatgattcgctcctagatccatgcggatagcggatgacggtgacagcccggtttttcagaaatgggagcagatagtcactgacttcaatcatatactgaataaaatcttcttttgttttttattcttttcaaatatgattttatccaggcttgtgaactggagctttgggtgaaccggtttggagtgtcgtatgacttgcgcatatgtgcattcggtccagtccatttggaattcgaaaccgataaacgatacctctcttaatgtgccttggagaattgttaagtattgaacagctgcacaaatcgaaggttcaagcgtaaattcgcctgagggtgtttgctgtccgtgctgttccataatctcgcgtatagcgcttttttcctcatcgcgcattccgtgcgagacagaggcaatcggtgtcattatcccgttttttaacacagataccgtcagaaacccgttgttagggttgaaccctgttatgcaaacataagcttgtttaaagtttttatatttgagccaatcggacgaccgcttcttttcaagccatttgctgtttgttttcttcgctacaattccttctccgtcatattttattaccatctcccagagttgatcaaaatgatcataacagggaatggattgaatggtttcttttgcgtaaggatctggagatgcaggaagctttgctgcggatatgagttcacgcagagattttttgcggtccaaatacgaaagaagcgttacatcttctccgcttcgctctaacaaatcaaaggcgagaaagcagcacggccgcgcgtttgccgattcctgaatcttgtctggccttttcaaacgcccccgcacttgaaggtgttcaaaatctgcacgacaaggattcaccaaacatacgatttcaccatcaagtgtcagcggaagctctttttccatgtgctgaaaggcagttttggcgaattgtgtgatttcagggaaggtgctgctgagctccacaccatttctgctggttaaggtcacacctgaagaatggatgcggagaatacagcggtacccatcatattttacttcgtaacgccattctgctccgattggcggtgacgaagttaagaccggctgcatggtaaacgccatgggctatgacgtgccggaggctttttttctagttgttttttgttttttatctccggctcctttcggttcagcggcttgtgcaggtgcggcagccggtgtctcccggttcggccttctggttctgtcaatgctggcttgcagagcgcttaccaggtcaatgacatcttcacgaggtggcgctttatcaggagtgacggccgtttctttattttctagcttgtcgttgactctttgcagcagcgcctgtcggtacgtgtcttcatatttcttaggctcaaactcagcagtcagttcatctattaaagtgatagcggtttgcagttccttatcgtttacattcgattgatcaggtacacctgggacatgagcggcgcttctgacctcatccggataatggatagactccatgacgatacaattttcataaacgcggagaatcgccagctgctgctttgacctgattgtcatattggcgataccgatctttccggttgagcgcagcgcctcacgcagcagggtataggccttcgtcccattatccccgggccgacaaagtaggagcggttaaagtaaatcggatcaatttcctgaagctgaacaaagtcaacaatctcaaccgctttctcctcatgctcctgttttaagctttttaaatcttcgtctgtcagtactacatatttcccttttacatattcatatcccttcacaatttcatcaggactaagagttttttcgcaatttgtgcaaactttctcgtatttgattggtgcgtgatcctctttatggaggctgcgcagtttaatatctttatcttctgtggccgcatatagcttgatggggatgtttactaatccgaagctgatcgatcccttccacattgtatgcatatcgataaacccctttttttctttagtgtgaagagaaggagtacgattcatgtgtagtaacttatgggtgaaaaaaagccggcgcttttattgcgacggctgttcaataatgaattgttcgaattgttccggaggtattggcctgctgaaaaagaagccctgcaaatggtcgcagcctttttcatatagaagctgcttttgagctgcattttccacaccttcggcaatcacctgcaaagacagctgatgccccatggcaataatagctccggtaatttgctctgatttaggatgggtctgaatatcgtcaataaatgatttgtcaatcttcagcctgtgaatcgggaagtccttcaaatagctaagggagctgtgaccagtaccgaaatcgtcaatactgattctgattcctaattctgtaagggatgacaaaacctttttggagtgatcgagattgtccattgtcatgctttccgtcacctccacttcaagaagctgcggaggaagctggtatttattaagcgtatccttgatgaggggaatcagatcttcggattggaactgtctggcagaaatattaatggcgacagaaagatcatagcctttgtcgtgccaaatccttgcctgcttgcatgcttcatctattatccactttccgatatcaataataagtcccgtttcttctgcgacaccgatgaattctccgggcggacgcagttgcccgtctggtgtcacaaggcgtatcagtgcttctgctcctgtcattttttgtttttttacactgaattgcggctgataatgcaagacaaatctatcgttttcgattgcttctctgagtaccatctcttggttaagtttgacggtttctttgttgccgattgaaaaagaatagtatctgtatttgcttttgtttcgttctttagccgcatacatcgccatatcagcctttttcatcaattcaaggccatcagtcccgtcttttggagatatcgcaatcccgatactgacagatgtgacaagggtgtgatcttgaatcttgaaaggttttttgaatttttggataatttttcttgctaaaacatctgcttcgcctgttcctgtattggcgtctgtcaatataataataaattcatcaccgccaagacgggcgataaatccgttatcagggactacagatgacaggcgtttagctgcaaactgaagcagttgatcaccgacattatgccctaatgcatcgttaatcactttaaaccggtttaagtcgagaaagaatacaacggtgttataatgcaaggaatgctcgcgatgcagcacctttgttagatgagagatggcatgccttctgttaggtaagtctgtaagcgaatcataatgagccattctatggatttctttttctgctttgtactgcttcgtcatgtctttgcaaatgacataaatgctgtctagttcctgattgacctcaacaggtataagcgtaatatttaagtgaaactggcctttttcagtgataagatcgctatcgctgttcatcgcttgtttatcttttttaacttgctcaaaaaggcgcttaatcttctgtgatgtgtaattcctccagtcatgcatgctgaagccaaatttgctgatcatttcctcaccagcgtgattggaagatattatgtctccttctaatgataaaataaagattgcatcaatattgtggacgattaaagactgaaatcgctgttcgttatcctttatgcgttcgctctgtttaataaactttcgatctgcatgggaactgaataacaataacgtttggatacaaaaaataattaaagtaacaaaaattgaccaatgaaacgtttgcacctccatatggcttccgggcggagccatgtccttatggaaagttgccgcaagcatccctgtgtagtgcatgcccgaaatcccaatgcccattacaattgaactgacgactttatagaatataagatgctcagaatgtttttttacggccaagtcaaagaatatttttaacgagacgaaagaggctgcaatcgcaatgataattgaagctgtaaataaaatcggttcgtaaataatcattacccgggaaatggcagacattccgatatagtgcatagaagcaatagatgcgccaagcacaactgatccggtaagcagtctgtaatatgtaagaatgtaccggctgacaaaatataatgacacaaatgatcccgaaacagatgcgccaatggctgccattaatggcatgaattcatattccatcggcatttccatatggacggccatcatccctacaaaatgcattgaccaaataccgaatcccataataagtgagccgccgatcagccaaattttactttttaagcctgtattgatggtgactttccttgaaagttcaagggaaatatacgaggcggtacaggcgataagaaaagataaacatatgagcgtcgtattatatgtaacgtgtatttccaaatggagattccccccgtatcgtgtgttccagtcttgttgactctctttattatcggctgcttaaccgcagagtttcagccttcaaaacgatagaaatacgagggagatctatttttagttcaactgaccgtgaaaaatgtgttaaaatcatcttgacgttttccgaaaaaacaaaaatgtatgatacataaacatggaacaagggagttggtggctatcgaagagctagttatgtcatggatagaagcatttaaaagcttatcttattttggaatatttctagcgctcagtattgagtttatcccggccgaagtcgtcttgccgcttgcgggctattgggtatctaaaggcgatatgacacttgccggcgttgttttggcaggatcgcttgggggagtggccggtccgcttacgctatattggataggccggtacggaggaaggccgtttcttgaacgttttgggaagtatctctttattaaacctgaagcgcttgataagtcagatgaatttttcaaaaaacatggaggctttgtcgccttcagcggccgtttcttgcctggtatcaggacattgatttccataccgtgcggaattgcaaaaatgaatgtttgggtgttttcgctttatacattcattgctatgcttccgattacatttgtatatgtttatctcggtgtgaagctcggtgaaaattggaaggaagtcggctctattcttgatcaatatatgcttccgatcgggatagccattttggcgcttttcctgctctacttactgatgaaaaagaggaagaaacgcacgcactccgaacaattatctgtatttttgaaaaataaacgttgacaaatcattgcgctgcgcatatcattgacgtataaaatcatatttcttgaaatcccaaaggggagtagcgtccggaatgtattccggaaacaaagtcgtcatttcatggattgtatccatcggctttgttggcatgcctgaattcatgtctagcaagacctttgccttatgtcggcaaaggtcttttttgcatggtccggccggcataagatcggatgaagagaaagaaaacaacttttttgggagggtatcatttatggatgcagcattattattagagtatggttgggttcttctcgtcttgatcgggctggaagggattttagccgccgataacgcgctggttatggcggtaatggtaaaacatttgccggaggaaaaaagaaaaaaagcgttattttatggattggcaggggcttttgttctgcgatttggctctttattcgccatttcatttttggtcaacgtatggcaggttcaagcgattggcgcgatctatttgctgtatatctcagcaagccacttattgaaaagatatgtatttaagaaagaagacacacataaagagacgaagcaaagcggtttttggccgactgttttaaaagttgaactggcagatatcgcgtttgctgttgattccatcttagcagcagtagcgctggcggttacacttccagggacatcactcccgaagatcggcggacttgacggaggacaatttctcgtcattttggccggcggtatcatcggactggtgatcatgcggtttgcggcttccatgtttgtgaagttattaaaggaacgtccaagcctagaaacagcagcctttgtgattgtcggctgggtcggagtgaagcttgctttatatacgcttgcccatcgcgacatagcggttgtttctgagcactttattcattctggaacatggaagctgatattctggggtgtcttagcagcaatcgcggtttgcggctggtttatgtcaggtgggaaaaaacagccggagggcgcacaaaacgagcaaaaaaacagcacccgtgaacgggcgtaatctgaaagactctgcttaaaagcagagtctttttgtatttgaagcgttttcataagcgaaataaaataacatttttataacatctttgttacaaaaaacacgcataaaaccccttaattctttagaaaggcacgaaatcatgtataggacgtcagaatggtttgtcataattgagacattggaaatcaatatttctttttctcctttgcgaatccctatcaaattagctatcattaatgagtagttatagggaggaactgaggtgaaaccagtgcttagccttttgtttaaattgggaaaaaagaagcaaacacttgaaaaagctgttgagagtatacaaaaaggcaataaagatctgcaaaatgaattaatacagcaatataagccatttatcgcaaagacggtttcatccgtttgtaaacgatatatagatgaaaaagacgatgagttcagtattggactgatcgcgtttaatgaagctatagaaaaatattcacctgaaaaaggaaattctctgctcgcatttgctgagcttattataaaaagaaaagtcattgattacattagaaaagaagccagaagcgcacaaaatataaatatcgatttacaggaaggagacgatcaggagtcatcacaaagcctgattgaagccgagctttccattgatgaataccgccgtcagattgaacaggagcagaggcgggaggaaatcctctattttcaaaagcagctcaaggattatggtttatcgtttaaagaactgcttgaaaattctccaaagcacacggatgcaaggcaaaacgccataaaggtggcaatgacgcttgtggaacatgaagaattggccgctatcctgtatacaaagaagcagcttccggtcaaacagcttgaacagcttgtctctgtaagccgaaaaacgattgagagaaacagaaaatatattattgcgatgtgtattatcattacgggtgattatatttatttaaaagattatcttaaaggggtgctgcactcatgagaagagggattatagtagagaaaaataaaaaattcgtcacgttgctgacccctgacggacaatttttaaaagccaaaaatgatcgacacagctatgaaatcggtgaagaaatcatgcttccgagtgaaacatgcatgggcagaagggccagcttttttgatttttttaaactgcgccctttcaaaatggggatttttacgatgactgctattatgctctttatttttatagttctccccgttttttctaataataaggcctatgcgtatatgacaatcgatatcaatccaagcgtcgaaatggcgttaaacagcgattatgaagtgattgaactgacgcctctaaacgatgagggacagaaagtcgtgaatgatatagatgattgggagaagactgattttaaaaaggtgattgacgatattataaccgactgcagtgaacacgggtatgtaaagaaatcgaaagaaatattgatttccactgtttatgaaaacacagaagacaatacatataaaaaggctgtgaaaaaacagctgaatgatgtgactgaaaaatataaaacgacataccgcatggaatctctcgagtcagatatgcaaacgagggaaaaagcgaagaaagaaggcgtctcaacaggcagctacatcaaatcaaatgaaaagaatgacaataaagatttaaaagatgactccagcaaaccatccggggaagaggatcaaaagagtgatgaaaatgaggatgaaaacaccgatcaaactgacacccaggacagcaagcaaggagataatgaacagctgaatgatgcggattccggagaccagaaagaagataaagcggatgaccagattgatgatagtgacaaagataaaaaaataaaggaatcagatgaaaatacaaataccgaaaaagatggggaccatgagcaaaccccaatacaagatcctcaagataaaggaaatgaaaataacggcgctgacaagggtcaaagccaatatcacagggactggaacaatggtgaacaaggcaagaaccgttcttcgtccagaagggataacgcttcagaccgacgtaatccaaacggctacagcagtgataataattcagctcaaaatgaagattcgccgagtgcccccggcgaataaagacctgaatttatttagttgtgccatttaattgtgattgtgcttgctgtaccagccgctttgtcatttctccgcctacagagccgttagcgcgtgcgactgtatcagaaccaaggttcacaccgaattcttgagccacttcgagtttaaattggtctagtgcctgctccacccctggaacaacgagtttatttctgctcgccatctttttcatctcctttttcgataaagaaattcttaacgcgtatttagtttgaaatatacggggtttatttatgctggcaattgttgtggagaaaaataaaaccccggcctctgagccggggtgacgcagactatagaatgtctgctgtcattttatgtgcggttgcctgaatatggaacgtcaaaatggagagaactgtaatggcgataatttgtctgattttaagccattggccgtcattcagttcttcaaaacggtgacggagacgctctgtctcctgttcggcgatctcctgtagattggattctttcatagaaggagtatcttggtgatggatggcatcaagcacatatgcgcagctttcataataagcaatcgggctgatgacatcatcagatctgtctgagattgtgttaaaggccacttttaaaatagcccgtatgtgttcaaagtcataaatggattttaaatcacgtacaattaaaagaataactgcctgttcaactgagtattttttgcccagctcagggtgtccgatcagatctttgatatcacgctttacccagttttgaatcgcggttgactttaacgaagttagctcgcataagttgccaagctctactatttcatttgtagaaagaccgtattcttttttctgtttttttcgttcgtatcttgtaagaaattcaggaatttctagatgattggctgctttttctgctgacatgttcgctgattggacgagaatgtcgagcgggctatgttctccttgtccttttagggaatagagcagccgcaccatatcggttcgagagagtttaaaaatgttcattgttcacctctttaaacaatttgacgcggatataggtctatgtataaattcaaagttcaagcgtcagcaaattacattaacatcatacgtcgaattccttgcattttcaaatggatgttttataatttaaatatacgggttcttttgaacttaaaataacggaggttgttatggcgaaaagaatttttctgtttattctaacgaatattttggtgcttacaacaatcgggatagttttgtctgttttaagctctgttacaggagtcgggacgtattttacagctgatggcggtatcgatccaatggcgcttcttgtgttcagtttagtcgttggatttgtcggttcctttacgtctcttgcgatgtccagatggatggcaaagacgatgatgggcgtcagagtgctgaatccgaaaaaacactcgctcagctatgaggaacagcaattggttgatcgtgttcacagattaagccgctctgccggtttaacgaaaatgccggaagtcgggatttaccgttcacctgaagtaaacgcgtttgcgactggaccgtcaaaacgccgttcacttgtcgcagtatcgtcagggctgctggagcagatggatgacgcagcggttgaaggtgtgcttgcccacgaggtcgcgcatatcacaaatggtgatatggtaacaatgacgcttttacaaggtatcgttaatacctttgtcgtctttttatcgcgtatcgccgcttggatagcaagccgttttgtcaaagaagatctagcgccgatcgttcattttattgcaatgattatttttcagattgtcttttcgatacttggcagcctggttgtgtttgcgtattcacgccatcgtgaattccatgctgacaggggaggagcggatcttgccggcaaggacaagatgattcatgcgttgcggacgcttaaaagctattcttcccggattatggaagacgatcagacagctgtccaaacgttaaagattaatggcaagaagcgctcttcgcttttctctactcaccctgatttagatgagcgaatcagacggctggaagctaaataatacaaacacattgttcctctgagagaattctcagaggttttttattttatccattgactaaaatcataaaaaaataagcaagttaagaaaatgtttcgtaaaagcctttaaaaatggacctaatatctttagaataattaccgtacttaaaaagagaggcagaaggattttacatgagattaaagtttggaaaattgatacaggccttgtcaccggcccagctgatcgcattatattattttcttgcagttactgtggccgttatattgctgagtttgccagcggcccataaaccgggggcggattggacgtttattgatgcgctttttacagctgtcagttcagtcagtgtaacgggactgacagttgttgatacagctgatacattcagcacaatagggatttttatattagcatttgttttgcaatttggcggaatcggaattatgacgctcggaacgttcatttggctgatcatgggaaaacgaatcgggctgaaagaacggaagctgattatggttgatcaaaaccaatcccagttttcaggaattgtcaatctgatgaagcaggtactgtttctgatcttgtggattgaattttttggcgggctgatactcggcacatatttcttaacctactatgactcctatcaggaagcctatttacacggattttttgccagtatcagtgcaacgacaaacggcggatttgatattaccggtaattcgatgattccatttcgccacgattactttgtgcagtttattacaatgcttttaattatatttggagcgattggatttcccgtgcttgttgaagtaaaggatttcctgttttcaaagcatcggcgttatccatttacgctttttacaaagatcacgacgattacgttcggctcacttgtcttgtttggagccattggcatctttgccctggaagcaaaccatgcgttcgcaggaaaatcatggcatgatgttttgtttttgtccctgtttcaatcaacggcaacccgaagcgggggctggcaacaatcgatatcagccaattatcagattccacactcttttttatttgtgcgctgatgtttattggagcgtcgccaagctcagtcgggggaggcatacggacaacgacttttgctttgaaccttcttgcgctgtttcattttgcccgcggcaataaggccgtaaaggtattcaaacgggagcttcaccctgctgacttgatgaagtcgcttgttgtcacgatgatggcgatcctgctcgtttttggcgcgacactcatgctgaccattacagaaaagcattccctgctggagcttttgtttgaagtgtgctcggcattcggtacaaccggcctgtcgcttggaattacggcagatttgagcagtgttggaaaatgcgtcattatgattgtcatgtttatcgggcgaatcggcattctaaccttcctgtatctgatcggaagaaaggaaattgaagcgaactatcactatccgaaagaaagagtgattatcggataggcaaaacaccgcatactttgcggtgttttttgattgccaaaaaaaagatgtgtgcctcctgttcagttggagaacctaacttcgacaggtgcaatttacgctcctgcatcttaaaatgtctgaaaactggcgaggaggattcgtatgaagcgtaaagctgaagtgaatgaagccattaaaaataacaatacacctaccgagagcatggaccccaattcatataagacacaatatcatgacgaccccaattttagtggggcaaaccgcaattccaaacagggccagcagggaggcatgtagttgtgaagaaaaaccgtcatagcagagacatgcaaaatcataaaaagcctatgaataaaaaggtgctggaggaagagttctcaagtgaacttggggattacaatgccgggaagatcatcgaaacgctggaagtcaccaagcctgaaaagaaaaaagaaaaaacaaaaataaaaaacaaaaataaaaaagacctcttaggcggcgtccgcttaagaggtgctttttctattttaaataagcatttttgcccgttcctctgacaaattgcaataagctggtcatcctcagctcaatgaagggctgagcgactgtcttaacaaagttgctggagaggactgatgtcagggctgctgttaaaagcaagaggatcactaagctttgatagtcagtaagccaatcctcaagcccgacctgccgtaatgttttaataataaacccgtgaagcagatacacgtaaaatgtccgggttccccatttggtaaagaaataccgtttttgcggaacaagcgctaaaaagctgaaggttgccccaaaggcgagtacataccagccgattcgggatagtccgcttaccagggtaacgtctccaaatgaagaatacggttttgaaccaaacagaaaagaatagtcaaaatcgatgccccagcagatgacgaatactgcggcaagcactccgagcgcaatttgtttaccgcgttttgatctcaataaatcaaaatgatgtttatttaaataaaaaccgacaaggaacatcggtaagaatacgaatgtccgtgacaagctcagcgtgctgctgacaaagtccagataaccgatcagcacggcgattccgcagctgacaaacagcgcccattgttttgaaagctttgaaaaaggatataggagcaggttccaaaagaataagcttacaagaaaccataacgaccattgcggatcaatcgggttcacatttgccatgctttcatcttgcataatgtaataaaagacggaataaatgatttggaaaatcaaatacggaataatcagcttgaccgccagcttttttacatatcccgcccgtttaaagcctttcgcgaaataaccggatacaagaataaatgcaggcatatggaatgtgtaaatgaacttgtagaggtagagcataaaatgattatcattaataaaggaacgaaggatatgaccgaatacaacaaggaatatcaataaaaattttgcgttatcgaaataactgtcccgcgatttactcatagcatcaccttctctttcatcagtcactaagagattattccctgctggtacatattttaaaataaaagatgaaaaaggaatctaaaaaaatgctgattgttaggtcgatgtaaagtgacggtaaggatcgtagaaaatgtcttcgtaatgtaatggcgctgaaattttctgaaatttatagggcaaatgaaggaagttcccgcattttgtagaaatattgagggataggttttgaagaaggagtgtacatgcatggaaactcttggtgtccagacaaactcggagctgcgagaggaactgaatcgcctcaaagaagaaaacgcgcgactgaaaaaggaattgaatcagcatcaagtgattgtcaacaatacgctcgatgctatttttatttgtgataacgaaatgcggattgttcaggcaaatgaagcaacagaaaggatgcttcaagttgactcggaagatttgaaaaagcgttctgtcttggattttttgttttccatcccaaaggatgaactgaatctttccgtaaagaagttttttaaaaaaggctttctgtggaaggaggttccgatcaggcttgattgcggggcaacaaaatacatagagtttctggccaaaagaggtattggcgaggatttcttttttgttgtcatgagggacatatcttctaagaagattctggagcgggaattctctatgaatgaacagctttttaaggacttgtttgacagagcagttgacggaatcgtcctgtttgataaagatggcggttttattgatgccaatttgtccttttgtaaaagctttgaaatcaatcataatgagctgtctcatttatctttgtatgagttcatagacagcggctcacgaaaagatttcgacaatatctggaaggcgctcaaccgcaagggaaaaacgaagggggagctgcctgtcaagcttcgttcaggagttcaaaaactatttgaattcacgattacatcaaacatcatcagcggtttttatatgtccattatgagggatatcacagagaagcggtctatggagctgcagctctttaaaagtgaggagcgcttcagagaaatctttgaaaatgcaatggacgccatcatcatctggtcgaatgacggaagaatcgtaaaagcgaatcaatcagcctgtaaaatttttgagctgccgatgaatttgctgttgaaaagaaagctgtgtgattttctcgttgactcgcagcagaaatacagcataacgaaaaggaaatacgcaaaatacggagagatcagagaagagctgctgtttcaaatggggaacgggcaattcaaagagcttgaatttacttcaaaacggacaatccttgaaaatcagcatttgacgatcttaagaaatgtaagcgacagaaagcggatggaaaaggagcttcgggaaagcgagctgaaattcagaaaagtgttcaacggctcaatggacggcaatgtattgttcgacaatcaatacaggatcattgacgccaacccgttagcaagccatattttgggcctgtcacatgaagagatcaaacagcacagcctgttagatattatttctgcttatgaaatagaaaatctggcatcaccggcaaggcagattaattttgatgaaatggacaacgaaattccatttttgctgagcagcggtgataacagaaaactcgaattctcatttaaacggaatattattcaaaatatgaacttggctatctttaaagacgtaacagagcgaaaagaattggaggagcgcctgcgcaaatcagatacccttcatgttgtcggcgaactcgcagccggcattgctcatgaaatcagaaatccgatgactgctcttaaaggcttcattcagcttctgaaagggagtgtcgagggagactacgccctttacttcaacgtgatcacctcagaactaaagcgcatcgaatccatcatcaccgaattcttgattttagccaagccccaggccattatgtatgaggaaaaacatgttacccaaattatgagggacacgatagaccttctaaatgcgcaagccaatctcagcaatgtacaaatgcaacttgatttaattgacgacattccccgatttactgtgaaccgaatcagctgaaacaggtttttatcaatatattaaaaaacgccatcgaagtgatgcctgacggcggaaatatttttgtaacgataaaggcattggatcaagatcatgttctaatctccttaaaagacgagggaatcggaatgacagaagataaattaaagcgacttggtgaaccgttttatacgacaaaggaacggggaactggacttgggcttatggtaagctataaaattattgaagaacatcaaggcgagattatggtagaaagtgaagaagggaagggcaccgttttccatattacgcttcctgtcagacagaatgctgaagaaagaaggaatgatgaatgaactactatacgacagccgaaacgccgctcggtgaacttatcattgccgaagaggaggaccggatcactcgtctatttctcagtcaggaagattggatggattggaaagaaacggttcagaatactgagcacatggaaacacctaatcttgcagaagcgaaacaacagcttcaagaatattttgcaggcgaaaggaagacattcaccctgccgctcagccaaaagggcactccttttcagcaaaaagtgtggcaagcgctggagaggattccatatggtgaatcccgaagctatgcggatattgccgctgcggtcggcagtccgaaagcggtgcgcgctgtcgggcaagctaataaacgtaacgacctgccgatttttgttccgtgccacagagtgatcggcaaaaacagtgcgttaacaggatacgccggaagcaaaacggagatcaaagcatttttgctaaacatcgagcgaatctcctataaagaaaaataaaacatatggcacgttcccttttttcacggccgacatatcattttattaagttaaaaaagttggtctgatgaaaaaggaggacaaagcaattgaagccgagccgctctgagaaacttgccgtttttgccgaactgtttgtgaaactgcatatcttatcaagcgctcaaaaagatgaaatcatcaatgttaacaaaaagaaacaaaaaaaccgctgactcggctccaaatgagcaaagtccagcggttttttaatgcaccttttctcctctaaacagctgttcaatctcttcttcatagtttccggtcataatccctttttctgtgatgattcctgaaatgagatcatgaggtgtaatgtcgaaagcgggattaaagacaggcacattggatggagcggtccgaactccggaaatctgcctgacttcctcgggatctcgttcctctatcgggatatcagcgccgcatttgacctttgtatcaaatgtagataaaggtgcggcgacaaaaaacggaatgtcaaaggcgtttgctaaaatagcaagaccgtatgtgccgattttatttgccgtatcaccgttctttgcaattcggtcggctccgacgataacagcggaaatttgtttttccttcatcgtatgggcggccatgctgtctgtgatcagagtgacatcaatgcccccctgcatcagctcccaagcagtaaggcgtgaaccttgcaggacaggccttgtttcacaggcataaatgtgtaatcccaaatctttttgtttggccaagtaaaacggagctagcgccgttccatagcggcttgtcgcgattgagccggcattgcagatcgtcatgatcctgtcgccttttttgaaaagctgcagggcgttttgtccgatcaaccggcacgtttcctcatcctcgacctgaatctgaatggcttcatggacaaggtttgtttttgcttcatttacggaaatcgcgttttcgaccgaatgactcagtctctcaagcgcccatgacaaattaatggcggtaggccgtgagctgtttaaatattgtttgatgtcttccagtctgcggcggaattccgtgacattatctgtttcaatgtttttggcagcaagcgctagtccgaaggcagccgtaatgccgatcgccggagcgccccttactttgagcgtgacaatcgcatcaaatacatcctctttcgtcgtcagctccaaatattccgtctcatcaggaagcttttgctgatttaaaatggtaatagctgtttctttccattcaacagaacgcggaacagcaaatgaatgggtcatgaatagatcattcctttacaagtaacttaaataattcaataacatctgttatcgttttgaattccgaacgtttttcgataaaggctgtgccggtttcgagtgccaagcgttttctgccgattcgtttatcaaacggcacgatcgtatccaggtcagctacatgggcaaggccgatcgtgcgtcgtatcagctcacagcccgcaaatccgattgcttcttcaaaaatatggctgagcgtatcagtgaggtaaccgtcgatgttggcgtaaacatccagactgtccttccgccaggcttcactaaacgtctcttcaaacgtttcccagacctggttgacatgttcatataacggctctctgtcagccccgtcacggctgagtgcgttcaaaaataagttggcgataaattgccctacatcaaagccgatcggtccgtaaaaagcaaactcaggatcaatcacctttgtttcgtgctcacttgcgaaaatgcttcctgtatgcaaatcaccatgaatcaacgtttctgcagacgttaaaaatgactttttcagcttagcggcttcgattttaacgctgtcattattccaaagcttttcgacaaaaggacgaagctcttcttcaaaatcatttgtgtcatggtcgaagaaaggatctgtaaaaacaagtctttccgtaatgtcgcatagctctggatttgtaaactgtttaacaagctgttttttcaccttaggttcaagcgcgtaatctgatgagtagaaaagtgtttttcctaaaaattcaccgatgtgctgcgacagatgaggatagttttcaccctcaatgagtccttttcttgcgatcttgaggtgagagagatcctccatgacggtaaccgccatttccgtatcagaataaaacactcttggaaccaggtgaggcacatgctcgccctgacggatgagagcgctgctttcgattcttgcacggtcgattgtcagcggccagctttctcccaccacttttgcatacggaaccgcctgtttaatgatcaatgctctgtcatgttcttgatcataaatatgaaaaacgtaatttaagttgccgtctccgatctcctggcatgtcagcgtgcttttgcttggaaaaaggccaagcttcaccgccaacgccacagcggagctttcatttaacgtttcgtataaaggtgtttttgtgactcccatcatcataacctccaattatgtaatcacttaatatgtagccgtaaaaaagcctccttctcagagagaaggaggcttaacatctatgtccgcctctcttatctctcagatcagatctgaatggaattagcaccgtgccttaagagaccagcgtctcggcgcgaaaaagatgcgccccatttcacaatggaattacggtcggttgctgttggggtcaaaaggccaaatccctcgcccaactctcgataagagaatatattcacttgtttgacaattctaatttatcagttgatgaacatggtaacaggtaatttagttagttgtcaatatattttttaatataaatcttttctgatatcatcgaaaacaggaatgctctcccgaacttctgcgctttcttgaaggtcgatttccgctcggactatgccttcttcccgaccgccttcagcaagtacacgcccccatggatcaataatcaggctatgtcctgcaaattcattatccggatttgaaccggtacaattgcaggctgcgacaaagcattgattttcaatggcccgcgcaataagcaggcttttccaatgatcaaggcggggaagaggccattccgcagaaataaacagcacgttggcgccttttgtcgtatgttttctgatccattccggaaaacggatatcgtaacagatcaatcctgagcttttgacgccgtcaagctcaaagtatccgtcttcggaaccggctgataaatacagatgctcatccatcagctgaaaaagatgggcttttctgtactctttaatgatttgcccttccttatccgcgatgtacattgtattataaacatcagaattcttcctgacagcgaccgacccggcgacaatatgaacaccatgtttttttgccgttttcttcagccagctctgagcggagcggccgtcttcgtcagcgagttcatcaagattggccagatcatatccggtcgtccataattcaggcagaacaagaacatcagcatgtttgctttcttttccgatgaaaaattcagccttttttatattttccgaaggtttgccgtatgaaatatcaaattgaagacaagatatcgtccatttcatctttttaacaccccaaatttttctttacttttttcatttaaccatatatgatgatggactatcatttcaagatttttttagaaggtgagaatagatgaaatttgaacagtctcatgtattgaaggaattgcctaaacaattcttcgcttctctggtgcagaaagtgaaccgaaagctcgcagaaggacatgacgttatcaatctaggacagggaaatccagatcagccgactcctgagcatattgttgaggagatgaaacgagctgtcgctgatcctgagaatcataaatattcgtcttttcgcggctcataccgtctgaagtcagcggctgctgcattttacaaaagagaatacggcattgatctggatccggaaaccgaagtcgctgtattattcggcggaaaagccggtttagtcgagctcccgcaatgcttgttgaatcccggtgatacgattttagttcccgatccgggttatcctgattactggtcgggtgtcacacttgcaaaagcaaagatggaaatgatgccgctcgtaaaggacagggcgtttctccctgattacagcagcataaccgctgaaataagggaacaggcgaaattgatgtatttgaattatccgaataatccgactggagctgttgctacttccgagttctttgaagataccgttcgttttgcggctgaaaacggaatctgcgtcgttcacgattttgcttacggcgctgtcggatttgacggctgcaagcctttaagctttttgcagactgaaggtgcgaaggatatcggaattgaaatttacacgctgtcaaaaacgtataatatggcaggatggcgggttggctttgccgtcggaaacgcttcggtcattgaagcgatcaatctttatcaagaccatatgtttgtcagtcttttcagagcgactcaggaggctgcagcagaggcactgttagccgatcagacgtgtgtggcagagcaaaatgccaggtatgagagcaggagaaacgcttggatcacggcatgccgggaaatcggctgggatgtaacagctcccgcaggttctttttttgcatggctgcctgtgcctgaaggctatacttctgagcagttctcagatcttttgctggaaaaagcgaatgtggcagttgcggctggaaacggcttcggtgaatatggcgagggctacgtcagagtcggacttttaacaagtgaagaaagacttaaggaagccgcttatcgaattggcaaactgaacctgtttacccaaaaaagcattgacaagaccttataacgatgggataattcaaaataatttataaaatctatattttcttatcaagagcaggcagagggacgagcccgatgaagcccggcaaccgacttataaagcacggtgctaattcttgcagctagcggctgagagataagattcggacgagaaacgaaacctctttagacgcgattgcagtttgaagaggttttttgatatggatgaaaatgaaaggagctctggcatgagtgagttattagcgacatatctcctgaccgaaccgggagccgatacagagaagaaagcagaacaaatcgcaacaggattgacagtaggctcctggactgatctgccccttgtaaaacaggagcaaatgcaaaagcacaaggggcgggtgataaaagttgaggagagagagggaactgctgcatcagaaaaacaagcggtcatcacaattgcctatcctgaaatcaatttctctcaggatattccggctttgctgacaacagtgtttggcaagctgtccctggacggaaaaatcaaattaatcgatcttcacttctctgaagcatttaagcatgcactgccgggaccgaagtttggcgtatacggcatccggaagctgctgggagagtttgagagaccgctgttaatgagcatatttaaaggcgtaatcggaagggacctgagtgatattaaagaacagctccggcagcaggcgcttggcggagttgacttgattaaagacgatgaaattttctttgagactggtctagcgccttttgaaacaagaattgcagaaggaaagcaaatattgaaagaaacgtatgaacaaactggacataaaacgctgtatgcggtgaatttgaccggacgtacggctgatctgaaagacaaagcgagacgcgccgccgagttgggagcggatgcgcttttgtttaatgtcttcgcttacggcttggacgttatgcaaggccttgcggaagaacctgaaatcccagttccgattatggcgcatccagcagtgagcggagcgtttacgtcttctccgttttacggtttttctcacgctcttttactcggaaaattaaaccgatattgcggtgctgacttcagcctctttccgtctccatatggttcggttgcgcttccaagagcagatgcactggcgattcatgaagaatgtgtgagagaggatgcttttaaccaaacatttgcggttccgtcagcaggcattcatcccggcatggttccgctattaatgcgtgatttcggcatagaccacattattaacgccggaggaggcgtacatggacatccgaacggtgcccaaggcggggggcgagcgttcagagccattattgatgcggtcctagaggcccagccgattgatgaaaaagccgaacaatgcaaggatcttaagcttgcgctagataaatggggaaaggttgaagccgtatgacgactcgaaaaccttttattatttgtgattttgacggaacaatcacgatgaacgacaacattataaatatcatgaaaacatttgctccccagagtgggtggcattaaaagacggcgtactttccaaaacgctgtcgatcaaggaaggtgtcgggcggatgttcggccttctgcccagccgtttaaaagaagagattacaagttttgtattggaagatgcaaaaatcagggaaggctttcgggaatttgtagcatttatcaatgagcacgagattccgttttatgtcataagcggtggaatggacttttttgtatatcctttgcttgaaggcattgtggataaagaccgcatttattgcaaccatgcttcatttgacaatgactatatccatattgactggcctcattcctgcaagggcacatgcagcaatcaatgcgggtgctgtaagccgtcggtcatccatgaactttctgaaccgaaccaatatatcatcatgatcggtgattcggttacagatgtggaggcagcaaagctgtctgacctatgctttgcaagggattatttattaaacgaatgtcgggagcaaaacctcaatcatcttccgtatcaagatttttatgagatcagaaaggaaattgagaatgtaaaggaggtacaggaatggctgcaaaacaagaacgctggcgagagctcgctgaagtaaaacgggaattggcagagagagattggtttccggctactagcggtaatctgtcaattaaggttacagatgagcctttaacatttctcgtcactgcaagcggaaaagataaacgcaaagagacggttgaagattttctgctggtcgatcaaaacggagagcctgctgaaagcgggcattctctgaaaccgtcagcagaaacgcttttgcatacacatttgtacaataaaaccaatgccggatgctgcctgcatgtccatacggtaaacaataatgtgatttcagagttatacggagaccaaaagaaaatcacattcaaaggccaggaaattataaaagcactcggcttgtgggaagagaacgcagaagtgaccgttccgattatagaaaatccggcacatatcccgacgcttgcggcactgtttgcggaagagatttcagaagattcaggagctgttctgatccgaaatcatggtattacggcttgggggaaaacagcatttgaggcaaaaagagtgcttgaagcgtatgaatttttgttcagctaccatttgaaattgaaaacactccagcatcagctggttaaataaaaggaggaattgaaatggctacaattcgaattcatgatgaggcaaatacaacgattgaaaatcaagaggaagtggcaagctttctggacagtcaagaggttatttatgagcaatgggatatcacgaagcttccggaacatctctcagagaaatatgacctgacagaagaagaaaaacagcaaattcttgataccttcgaaactgaaattaaagatatctcaacccgccgcggctataaagcacaggatgttatttcattgtcagacagcaatccgaaacttgatgaactgcttgaaaactttaaaagagagcatcaccatacagacgatgaggttcgttttattgtaagcggacacggtatttttgtcattcaaggcaaggacggcacgttttttgatgtccgtttaaaccctggagatttaatctccgtgcctgagaatatccgccattacttcacgcttcaggaggaccgcaaagttgtcgcggtgagaatttttgtcacaactgaaggctgggttcctatttatgaaaaagacagcgtgaatcaataagcatgagatagccccgttcatcgaacggggctttttatatttattgcaaacgccacttttcatattgtgacagttcttttttaatcagtgtccaaatcaaacctaaaacagctgcatcgtcaatgaatccaagaccgaggattacgtctggaatgatatcgagcggcatgacgatatacaggattgcggcagttaacagcaaaagtgttttaacctgtgaacgagggtagtcgccatttcgccaatcgcgaagcatctgaaaaaaagtagtaatgtgctggatacatttttttcggtttttcctctttaaaatcgcttttccgcctgccgctccgagcattattgctttctttttcttcattgggcatacctcctgcctggcggcgtgtttaagatattcttcacctgggtattgttcttctaatcctatcaatatatctattatacctgaaaaattaacttatttaatgaaaatatgtttacaaataaagtataatctgtaataatgcacaataacccaatcaaacttgtttcctatttcttagcggcgaggggtgaagtgaatgggcggttcttctgaacaagaaagattgttggtgtctattgatgaaaaaagaaagttaatgatagatgccgctagaaagcagggatttacagggcatgacacgatcaggcacagtcaggagctggattgtttaataaatgaatatcatcagcttatgcaagaaaacgaacattcccaagggattcaaggccttgtaaagaaattaggcttgtggccccgcagagatgttatgccagcatatgatgcaaataaatagcggcctatcagatgcatatataaagagagagcttttcggaagcgctctttttttctggaaaaaattcatatgaaagagggaactaatgaaggaactggcgattctcattaccgaaatggtcaatcaatttcatgatgcttttatttccttatgcggaatatttggcattcatttaactgacaaagaaatgcatttttgggtgatcggcatttttggcatattctttttcggcgtcactcacgctgtgtttacatggctttctaaatggagtatgacagccttgtcctttatctataccgttacagtcatcattgtcatcgtatttgcgattgagattcagcaaaaggtgacggggagagggaatatggagtttttagatgccacggaaggtataaagggttttttagtattttttatgttttttttgcttttgaaaatgctgttgcgtttcatcaaaatccttttttctggaagaccagcaagcaaatcgaatggcaatgcccgatcacgaagataaaaaaccctcctgacatggtcaggggggctatgatgcggatacggggagggtgatcgtcacctctgtgcctcttcgcacttcactttcaatatgaatagagcctccgtacatcagcacgatccgtttacaaacaacaaggccgagaccggttcctttttctttagaagtaacaaagggaaggaagatgtgatccagcatttcctgagaaatcccttcaccgttatccacaactttgattatggcttttttatctaaagctcctagggagatcgtcagtttgcctccttcaggcattgactcgaggccattttttgctacatttaaaatcacttgtttaatatgatcttttgtacattttacgagtaagggctgctcggttaaatactgtaattcgacttcaacattgtatagattgccctcagaataaatgatcggcataatttctccgataatgtcctgaagtgagttcagctcccatttttcagctgtcggcttgccgagaacgagaaactcactcactatttgattgatgcgtttgatctcctgttcgataatggagaagtaaagctgatcttcctcacctttatatttcttttgcaacagctgaataaagccgcttatcccggtgagggggttacggatttcatgggctgtgctggcagcaagcgtcccgatcagctctaatttttgcgcctcattttctgagcgctccagctgggtctgccgcttcagcaaataatacagcacgagaataaaaaggatattcagcagaacaataatacatgaaagcggaagcactaggcttttcgtcagttcttctattgtgaccgggttcggatagactttcatattccagctgatatcatccagatatccgctgacaggtttctgatcctctgcatgagaggcttgtccgctcgcaaaaatcattttcccgtcttggttcacaacttcaatataaacatcagggctcagcaagttaatgagatttttcaaataatcaatttgaattgctgcgacaagataatctgtcacattacgttttgagtccaaaacaggcacacaaattgtgaaaattggctgaccagtaattctgctagaataactatctgaaatgactgtctttttagtttcctttgcttttgtaaaaaaagatctgtcggccaggtttactttcgtttttaattcggttgtgcttgcggtgacgtctcctttggcattgagaaaatagagaccggaaaatctcggctctgaatcaaaggtcttttccaaaattgactgcattttctttatatcaaccggtctgtcgatggcgatggacaaggaggtcattctcgccattgtttctccgattaaataattgattttgttgcggtgaaggtttagcaggacacttgcttcttgtttatgttctgcagctattgtatctttttctttttcatatacgaaaaagctgatgacgattgccggaatcacgaccagtatgatataaagtttgactctcccgcaggcgccttttagtattttcaatttgcatcgctccaacatacacctgattagaggtattatatcattgtttcttcttctttaataagaaaaaataaccaaaaaaattagaaaaaggtgttggcaagcttacattttaaaaaagaagagaaatattggaaagatttttattgacattttggtctttgtttattaatgtttctctgtaacggtttctaaaaggatgattgagacatgacagaaaaatcactgaagttatttatcgtgctgtcgcgcgcgtatcggtctattaacgatcatatgaataagcatattcataagcatgggctgaatccgactgaatttgctgtgctagagcttttgtaccataaaggcgatcagccgctgcagcagataggagataaaattctcttggctagcgggagcatcacatacgttgtagataagctggagcaaaaagaacttctcattcggaaagcgtctcctacagacagacgagtgacatttgcgcaaattactgaaaaaggcatcggtcttttgaacgatattttccctgatcacgctgctgaaattgatgaaatgatcagcgtattaagcgaagaagaggtagagatgtgcaccgaaatgttaaaaagagtaggattaaacgcaaaacagtttcataataagtaaaaaaaggaagcctgatatgtcacaaggcttccttttttgctatttttcatttgtttccgctgcgcctcttggcaaaatgagaacttcaacccgccggtttttgcttcggccttccgcagttttattggaagccaccggtttatactcgccataacccttggcgctgaacacttttgcatcgagcttggggttttcaatcaggagccccataaagtttaccgctctcatgacgcttaaatgccagtttgattggaattcagaatttttaattggcatattatcagtatgtccgctgataatgatatttcttggcgggttaatcacaagaagatttgaaatctcttttgcaagcggcacatcttccttacggatggtcgcttttccagaatcaaagaagatgctgtctttaatcgtaatcagaaggccttcactagtcatcttcgtctccagctgatgttccagctttttatctttgatgaacttttccacctggctcttcacattttcaagttcttcttgatcagctgctttttctttttctttcttgtttttctctttctcttctttttcctttttcacttcatcgatgccgtctgactcgttttcaggaggagtgacactggagtagtccagtacaccggttccgcctgtaaaaacttcattaaatgattttgagagcatttgaaacttagctgcgtcaatcgagctgctcgcgtacagcacaataaacaatgccaggagaagagtaaggatgtcggcgtaaggaacgagccatgattcatcaacgtgctcgtcctcatgcttcttcttcttttttctcgccattttgcgcctctccttgttctgcaaatttcaagcggtccttcgcaggaagatacattaaaagcttttgttcgatgactttcggtgcttgtccttctaaaacggataaaacaccttcaatcatgacctcacgcagttttacttcctgttttgattttcgttttaatttatttgcgaaaggatgccataacacataccctgtaaagataccgagaagtgtggcaacaaaggcggcactgatggcgtgtccaagctcatctgtgttatccatatgagagagagcggcaatcagcccgattacagcgccgagtactccaagtgtcggagcgtacgttcctgcttgtgtaaaaatagcggctccggcttggtgcctgtcctccattgcttcgacttcctctgtcataatatctcttataaattccgcgctttgcccgtcaacagccatgctgagcccgtttttcaagaaagcatcatctacatcctcaatgcttgcttctaaagcaagcagaccttcgcggcgtgcaagctgagcccattcagagaacataggaatgagttcctctattgtgagctgtttattttccttaaataacactcgaaacagcgtaggcacttttttaatttcttttgttgggaacgcaataacgactgctgatattgtcccggcgataataattaaaatggcagcggggtttgcaagggcgctgaaactgacgcctttcagaaccatcccgacgctcaatgccacaaaagcaagaataataccgattaacgaagttttatccatagttttcaccaaatccttttttactagcttgtctatggttaatatcggttttggtgcccggaactttagggacattgtgaatttgttcatgaaatattcaaggaagaggcatagaagggagaaataaacaaaaacgggctctccaaaattgaaaagcccgggggtctactgaaattagcagcttgcttgcaagctgtccttcagatggtattcatataatagtagaaatacatattcactgtatataaacatgttccatccctccttaaaaaaagtgtaaaggatgaagggaagtagcgcttcaggagaagggacggtaatttctaagtcaagagtatgaaagtataaaaaaagcggcttcctaaaaggaaaccgctgattgttattttgctcgcactttgattttatcatcttctaaaatcacgtgaaaactggtgatctcgccattatcaagcagcagatcggtcatttcatcctcaacccattcttggatggttcttctaagcggacgtgcaccgaatgaagggtggtagcccagctcagcgattttttctttcgcttcatctgtcacattcaagctaatgccccgttcagccaatgtttcttcaagttctccaagaagaaggctgacgattttgacaagatgttctttttccaatgagcggaactcaataatgctgtcaaaacggttgaggaactcaggtttaaagaacatgctcagtgaatcaatcaatgtttgttcttcgatgacactgtcatctgattggaaaccgactttcgtttgtttctcaccagcacccgcattacttgtcatgatgatcactgtgtctttgaagcttacagttctgccttggctgtctgtcagacggccatcttccataatttgcaggaacatatgctgaacgtctgggtgtgctttttcaatctcatccagcaacacaatgctgtaaggattgcggcgcactttctcagttaattgtccagcttcctcatggccgacatatccaggcggtgaaccgataattttagatacggcgtgtttctccatgtattcgctcatatcgagtcggataatagcgtcttttgtgccgaataattcatctgccagtgttttagaaagctctgttttccctacgccggtaggaccgacgaagaggaaggagccgactggtctgtttttggattttaaaccggcgcggcttcgtcttaccgcctttgccactttttgaacagcggcttcttgtccaatcacgcgttcatgaagttttgcttcaagctctttcattttcgtttgttcgtctgcctgcagtttgccgacagggatgcctgttttttgttcaacaatttcctgaatgtgctcagcttccacagtgacagcggtatgagcggaggagctgttcagttttttctccaatgcgagttcttcatcacggagttttgccgccagttcgtaattttcttcttccagggcttttgttttttcggcttcaattgcagttaagcgttcagcggcatcctcatcattcagttcatcaattaacaggttggcttttgaacctgcttcatctaataaatcaattgctttatccggcaggtgtctgtcctgaatgtagcgggatgataaagtgacacacgctttgattgcttcatcactgaatgttacgccatggtacgcctcgtatttgtctttaatcccttgcagaatgaggatagcctgttcaattgaaggctcctgcaccatgacaggctgaaaacgtctttccagcgcggcatctttttcgatttgacgatattctttcagtgttgtcgcgccaatgacttgcagttcgcctctggctagggccggtttgagaatgttgccggcgtccattgatccttctgcagagcctgcgccgacgagaaggtgaatttcatcaatgaacagaatgacattttttcgttccttcagctcagtgatcagctgtttcattctctcctcaaattggcctctgatccctgtgtttgcaacaagggatgcaacatcaagcaaatatagctctttgtttttcagtttgtttggaacatcaccttcagcaatttttaaagcgagcccttcagcgatggcagttttccctacacccggctcaccaataagaaccggattgtttttgttccggcggtttagaatttcgatcactcgcgccacttcatcatcacggccgatgacggggtcaatgagaccggcttttgcaccgtttgtaatattttgagccagctcatcaagcaaccctttttttccgctttgttttgctgcgctcttttctttcggctggaatgcctgttcaaacggaaatccgaaagattgaggacccatactcattgaaggtttacgggtcagttcgttatagcaagtttcacaaagaaccatctgtttatgaacggaatttatttgcatgttaaggcgaatcgtcgcctcgttttgatgacaatgttgacaacgcatttgccaaaaacctccttaataatttgatcttctttgaccaatgaaagtgaataaaaaggtctattggatttgaccttctttgactattagtatacggcaaacttaacggcattcaaaccaatatgctcaaagcagactgaatatttgactatctttgaccaattgatttttaaaaaaggccggtttgtttgaccaactttgattaatagtatactctgaccatctttgactttcaagtcttttgcacaacattttttaatttgttacaaagtaaaacatgttttcttcgtcttttcaaggaacttgtctcataggttataaaaaggcatctatggacaaaactgcggttcgttcggaggggagaaatggaacaatcaaaagggtctgcaagtcagcttgcttttgtgtatgtcggcacagtagtcggagctggatttgcgactggcagagaaattgttgagttttttctgaagttcggctggttcggtttattcggcattctcgtcagcggcggaatgtttacgtttctgggcgccaagctgatgatcatttcaaagcgaatcaatgccaagtcatatcaagaaatgaacatctttttgttcgggcggcggctgggcggattatcaatgtatttatgctgtttgttctcctcggagttacatctgtcatgctttcaggggcaggggcgctttttgaggaacagctggggatgtccgctcagattgggatgcttattacaatcggtctgagcttaattgtgatgactagaggagtaaaaggcattttcggtgtcaatgtgtttgttgttccccttttaatcctcttttcaatgattgtagtggccgactcttttatattcagcgaatcacgaaacgcagctcagtgggtctggccgcatcgctgggattggctgttatcagccttttcttacggggctttgaatttatcgcttgcccaagcagttttggttccgctggcgaatgaaatgtcctcggagaaagtgatcaaaaaaggcgctttaatcggagggacgatgctgacgattgtgctgtccgcgagttttctgtctttgtcaactcttccggatgtatttttgtatgatataccgatggcacaagtggtttatctctttgcacgatctgtccatttgatttatttactcattattttcggagaagtgttcacatcagttatcggtaatctatatggattagaaaaacaagtgcaaagctttcttccagtgaaaagcaaatatatctttgcggccattatgatcacggcttatattacgagccaaatagggtacggcaggcttatttcaacgatttatcccttgtttggctatgtgagcctggccttcataggcgctttgctttgcaaaaaagctcctcggcggcgcagtttataaatatatataatgaaacgaaccgtcactatagagcgataattgatctaggaaccggggactgacttttttattgtcaagaaaaacatcattatggtaagatagcagaagtgaaaaaattgaagaaaatccgtgcgatatgcgggagaggttctagctacaccctctataaaaaactaaggacgagctgtatccttggatacggccttttttatgtttttctagagcaccttccgaaaaaaggtgtttttttgcgtgaattagctgtagcgatgtctctcgccggcgtttttattgcggagaaggagaggaatcatgaaaaaagaaaaagcaattgtcgtatttagcggcggccaagacagcacaacatgcttactgtgggccttaaaagaattcgaagaagtcgaaacggtgacttttcattataatcagcgacattcgcaggaaattgaagtggcaaaatccattgcggaaaagcttggtgtgaaaaatcatttgcttgatatgtcacttttaaatcagcttgcaccgaatgccctgactagaaatgatattgagatagaagtaaaagacggcgaactgccatccacattcgttccaggccgcaatttggtattcttatcctttgcgtctatcctggcttaccaaattggcgcgcgccacattattacaggagtttgcgagacagacttcagcggttatcctgactgccgtgacgaattcgtgaaatcttgcaatgtcacggtaaatctggcaatggagaagccgtttgtgatccacacgcctctcatgtggctcaataaggcggaaacgtggaagcttgcagatgagcttggcgcgctggattttgtgaaaaacaacacgctgacatgctataacggcatcatcgcagacggctgcggcgaatgtccggcatgtcaccttcgttcaaaaggttatgaagaatatatggtgatgaaaggagagcgtgcataaattgttatctcaaatttatccgcaggcccagcatccttattcgtttgaactgaataaggacatgaatatctcagccgctcattttatccctcgggaaagtgcgggagcgtgcagcagggttcacgggcatacgtataccgtaaatataaccgttgccggcgacgaacttgacgattcaggctttcttgtcaatttcagcgtactcaaaaaactggtgcacggaaactatgatcacacgctattaaatgatcatgaagatttttctcaggacgaccggtattcgctgccgacaactgaagtcgtggcgaaaacgatttatgacaacgtacaggcttatttagacactttggagaataagccgacctgtgtacaggtgtttgtccgtgaaacaccgacaagctactgtgtctaccgtccgaaaaagggtggtttgaatggctaaaggaattcctgtattagaaattttcggcccgacgattcaaggagaaggcatggtgatcggacagaaaacgatgttcgtccggacagccggctgcgattattcctgcagctggtgtgactccgctttcacttgggacgggtctgctaaaaaagatattcgctggatgacggcggaggagatttttgcggagcttaaggacattgggggagatgcgttttctcatgtgacgatctcaggcggcaacccggctctgttaaaacagctggatgcttttattgaactgctgaaggaaaataacatccgtgcagcgcttgaaactcaagggaccgtttatcaggattggtttacgctgattgatgacctgacaatttctccaaaaccgccaagctcaaaaatggtaacgaactttcaaaagcttgaccacattttaactttacttcaagagaatgatagacagcatgctgtcagcttgaaggttgtcatctttaatgatgaagatctggaatttgccaaaactgtgcacaagcggtatccgggaatcccgttttatttacaagtcggaaatgatgacgtgcatacgacagatgatcagtcactgattgcacatttgcttggaaaatatgaagcgcttgttgataaggtagctgtcgatgcggagctgaatctcgtcagagtgctcccgcagctgcacaccctgttatggggcaacaaacgcggagtataatagaaaggaagatgaacatgacgacaagaaaagaatcagaattagaaggtgtaacattgctaggcaatcaaggtacaaattatttgttcgaatatgcaccggacgtgctggaatccttcccgaataaacatgtaaaccgtgattactttgtaaaattcaattgcccggaattcacatctttatgtcctaaaacaggccagcctgactttgcgacaatctacatcagctacattcctgatgaaaaaatggtagaaagcaaatcattaaagctgtatctattcagcttcagaaaccatggtgacttccacgaggactgcatgaatatcatcatgaatgacttgattgaattaatggacccgcgctacattgaagtatggggcaaattcacgccaagaggcggaatttccattgacccgtacacaaactacggaaagcctggcacgaagtatgagaaaatggccgaataccgcatgatgaatcatgatttgtatccggagacgattgataaccgttaattattccgttgtgtgatacggagtgtgaaacgaagtggagtcacagtaaaatccgaacattcagcgttaattttcagcggaaatgtgacccgaagtgaccggagtgtgacctgaggtgcaacctgaactgtgacttttatgcagtgaaaaattgatagtacagaagcagattaaggcgtacaatttgtacgtcttttcttttttatccgaaagaaaaaatgcctatctagagatcataggcattaaatattattatcaatatcttcattattttttggctaagtttctgaatcttctctttaacatttgaaacagctcttttttgaatttcatcaaagttctcctgaatataatcgacacttcttattagaacttcactttcaaaattgaatatctcatttatttctgactgttcttcatctgttaggtgatggtattgaagttgtttagcatttacttcagcagctacatcaatcctaacttagttgttctggttgtacaatttcatattcaccttctgcatactcttgctccgcataatagcctccccattgacagagctcctgcaagataggtttaagagattctccaagttcagtggatgaatattcaaccttcggcggtacttgattatacatctttctgctcacaagtccactggcttcaagctctctaagtgtttgaatcagcattttctgagttatatttgggataatgcgctttaattcactcgttctctttggtccattcattaaaaagtataatacaaggcctttccattttcctccaataacttcctttgtcacttcaaacccacagctaaattttttcatgtctaaagctctccattccacatttattactttttagttactatatcacaaaaaagtgggtacttccgataatgtgcttactgaaggatactatatcttgtaagttgttcttcaagtacttaaaggtactagacataaaataatattaattctaaaggagtgttaagtatgggtaaatttgaaggtaaaatagcgcttgtaacgggtggaacaagtgggattggtcttgctacagcacaaaaatttgtaaacgaaggtgcatatgtttatatcacgggacgtagacaaaacgaacttgataaagctgttgaccaaattggcaagaacgtaaccggtgttcaaggtgatatttctaagcttgaagacttagacaaactatatgacattataaagcaggaaaaaggtaagttggacattctttttgctaatgcaggcatcggcaacttccttccattaggtgaaattactgaagagcaggttgatagaacgttcgacattaacgttaaaggaaccatctttactgttcaaaaagcattatcactattcccagacaaagtaggttctattattgtaacgggctctactgctggatcaattggcaacccagcgtttagtgtatatggagcatctaaagcagcattaagagcactagttcgcaactggattcttgacctaaaaggtactgaaatccgtgtaaatgtggttagtccaggaggtattcttacacctgcctacgatgagctttttggtgatgcacttgaagaggtactggaaaatagcagaaatactgttccagctggaaaagttgggacacctgaagaagtagcaaacgctgtatctttccttgcttcagacgaaagcagttacttgacgggtgttgaattgttcgtagatggcgggctagcacaggtataatttccctgcgcagagattacaaatagtccccaaaaaggttgatggggatttacttgaagaagtcgtataaaaaagtcgttttccttaaaggacagggaattcgacttttttatgtttgaatttgcttaacgttgtaaattcgcattttcctggggctaccactaaatgacctgtaaaaaagattacactgtgaataaatgtacttaaagtaacgggggatcttgacttttaataaaaaataatatccctgtccttgtattccaatacttttgaaaatatttaaaggaatccttatgtcctgaataaccacataggaaaatatgttgtaggttgctttctttttttgtagggcatcccacacaagctatcacgtgatctcacacctgaacgtttttttatagactagtaccgcgacaagttatattacatatacataccaataaagtagacattaaaaagtgaaagagaggatggaaatgtgtgaaaattcttttccttgagagtcatcccatgtggctctatggtttaccgaatgggtttagggaagcaggacataccgtaatgatttccggtcctgtaagtcgggaaaatatcactgaaatgatagacgaatttaaaccagatctaatagtatctatgggatggacaccagagcattcaagggaaaagcaggcctggattcgcaacgctactaaaaaggtgaatatccctctcgtttattgggcaactgaagacccgctgcacactcaaaactttactatcccgttaattaagaagatgaaaccagattttgttttcacggttacgccttctctgtgtaaaacttatgaaagcatggggattaaagcagctcacttagactttgcatttcacgaaagtatacatcaccagattaaaccattagcaaaatacagttgtgatatagcagtggtggctaatgcttaccctaattttcttgaagaacatccggaagtgttccgttcgtcctctttaaaaacgcttattcgtcctcttatacggaagggtattcgcattgatttttgggggagaaactgggaaaaaatgagtaaatatataggaagagaaattccccccaattggatccatggataccttgattatactgaagcatataaagtttacagttcagcaaaagtcgttatcgatttgcaaaactgtgaaagccaacttacgcaacgcacctatgagattcttggttccggggggtttttattgacatcggatacaccagcagttcgagataaattcaaacctggccgcgatctcatcgtttcttcctcccaaaagaaactttggaaaaggttaaatactatttgaatcatgatagcgagagaaaaaagattcagataaacggtaaaaaggctgtaaagaatgattcctatcggcatagagccgagagaatgcttgaggtgctaaaaagcagaggaattataagaaacttaggggaaaccattcattatgtagatgttctcaaagaaaaatacgtgatccatcatgttactcccggtgaaacattatcaataattgccaggaagtataatgtttccctgcagcaactcatggagcttaatcatttcaaatcagatcaaatatatgctggacaaatcattaagattagagagaaactgtttagaaatattaataacaaattattctaaaggagagtaatatgaatgaaggggaaaatacctaaaataagaaatcaagcgaataaagtaaaaagaacgcctcgttatatggaatttcccgtaacatacgaagtgtatcatgtggaatccggcgatacattatggacgattgccaaatcctttaaaattccggtacaacaacttatgaatcttaataagctttcttcagacagaatttatcctggacaaattataaagataagagaaaggtaatctttgaggtttcggaagcgaatcaaattgaaatgacaatcctcatttttttatttgtggggaacttgatatttttggggatgaaggggttatgagatgtttcaaatgagctatttctattctggattaggatgggattttattcaacacgttgatcaaacgaacggagtattaaatgttgtgtctcctgattttttctatatcagaaaagatggatcattacttctccgttcagctaatcccgatgtgattaaagctcttcatagaagaaaattaaaagtagttccttttctaagcaatcattgggatcaggatttgggacgatttgcattaatgaaccgagttcttttagctaaacaaatttctcatgcaatagaagaactggatttggacggagttaatatcgatatagaaaaccttacagaaaaagatcggaatctatttacagattttgttagattggtaagggaaagtattcctagacataaagaaatatcagttgcagtggcggcaaatccttttggctggacgaagggctggcacggatcatatgattacgagtatttagctaaatatgcagattatcttatggttatggcctatgatgaaagccgccttgctgggcctaccgcaagtgtaggatgggtggaaaagtccattcaatatgttctgacccaaaaaatctctcctcaaaaactagttttaggattgccattctatggccgctgctggatggaaggccaatctgcctctcaggccattcccctttaccttgttgactcattagtaaaaaggcatagcgggacaattatttttgacaccaagagtcaatctccaaaagctatttttactgtcaatcacgataacaaggggccgttgccttcgggaacatatacattatggtttgaaaatgaacagtcactcagagcaaaaataaaactcgctcaaaaatataatctgaaaggtcttggcagctggagtcttggacaagaagatgtgtcagtctggaatacagtgtttaaaaatatataatgatttatagttcagaacaaaattcgaagataattgcaatgaatctctaaatggacatactgaaaggagtttattacgggtgcgggtaaaacagtgagggcattccataggcccttctcccgaaatgttctatacgaggcattacattgggcttgaaatacacattcaaacttatgttaagtacgcatttcaagtaattacggatgtgttgaatttattctgcttccatgatttaagtcatacacatgtaccttaatagcaggattattgcatttcattcagaattgttcaggatcgatatagaagcgcaaactagaactttaaaagcatacactcatatacttcctgaatggatgctggtttatctaaaaaacatgatgagaattgattgaccgctctcattaaaggatggggaaattcaaggcgccaaggtacgcagaaatgagggggtttttacataaaaaagacgagcgaatccgggggaattccactcgccgctttctaatgaaaagacgggatgctggatggcagctcgtctgttttattataatttaacgaacgtatgtttgtaaaggtgtcttttcgaatgaattggttcatataaccgttaagaacagattcattgtaaacattcgctaaggtatgctaagatgcatggactataaaggagtgatatgaagtgaagacattgcggttaaacaatgtaacgttagaaatggctgcatatcaagaggagagcgagccgaagcgaaaaattgcatttaccttaaacgttacgagtgagacttaccatgatatcgctgtcctgttgtatgaaaaaacgtttaatgtcgaggttccggaacgcgatcttgccttccggggggaaatgacaaattattcaacatcattgaccaacctgtacgaaccaggggccgtcagcgagttctatatagaaataacggaaatagacaaaaacgccgattcatgatcggtgttttttatgtaaaaaagctgccggccggcagcttttgagaaagcgaatttcatatgtaaggtgttaaattgtccgtcttgcagtttttgaataaatgtggaaataaggaggttttaataggagtctctgatgatcttataatttttatgattaacaactgtcaatgaatctaactcaagatcccgatagttatccatgatcgtcacatcaacgataacagaattctcatttactttttcaacaacaccggttaatccgtttttaaattcaatgacattcccaaccttagcgattttcacaagcttcctctcctttaaacataataatgccttttgaaagtattttgcagtattttcattgagaagtaaagcgataaggagttttatctcccttatgaattgttctgtcgctataaagatgatatattgattttcgtcgatagaaagaaaagggggaatttttgttgcgtcccgaagaaataacagaaatgattgaacagctgcgcaccggcgccataaacgaactgagagtccagaaagagcattttcttgatttcagggccgtgttatctaaacaagatgattttaaacatttccgaggaattgcccagcaaggcggagatgttatctttcaatacttagaacagccaagaagctgaaggtttctcatacgtgagaagcctttttatcatatatgacagaatacaagccttttattacagctgtctgtaacaggcgtaaataaaatgtaaagtgtcaaagatggataaacatgttttaatttgacaatatttatagaatttcagactgtttttttgccattaagcagtgagtcatcctctttattccatcctgatacctccttgggagagttggaaaatctttttccgtgaaaatgaatggatctcttgttaaggttatgaagtgttttttggagcactttaaggaggaaactgtatgacaacgaaattcactgctctggctgtttttcttctttgtttcatgcctgcagccaaaattgagcatacacaagcttcactactgagcgcaaagaagacaaaacatgaagaagcgaaatggcttacacatatagatcgaaatacgaatgaatctttcccttcactgtctgctgataaggacaagaaaataaaaccgattaagctatcagcacacactgaaaagaaagagaaagataaaccggacaaaacaaatgatgagaaagaaacatatacacagtctgaaaaagagttgctgtcccgtctcgttcacgcagaggccaaaggagaatcatataaaggcaaggtcgctgtagcaagcgttgtactgaacagaacggagaaaaaaggttttcctgatactataagaggagttatttatcagaaaaacgcctttgaaccggtcgcaaacgggagcattaaccaaaagcctgataaagaatcgattgaagctgccgaagaagcgctgtcctcaaaaaatagagaaacagatgccatattcttttataatccgaaaacagcgtcagataattggattcgttcaagaaaaatcgtagaaaaaatcggcagacacgtttttgccgtctaagcatagaagagacaatttgtctcagctgtgctttttttcatataaagagtaaaaataaaataatttttgaacttgtctcatatgatgttggtagtacaagagacaaggagagacatcatgaatcgatttgtgaaagggatcattcttttatccattgccgcctttttcgctgaatgccttgaatttgtcgtcaatatgattttggcgcgggagcttggcgagcatgggatggggctttacatgagtattttgcccacgatctttttaattattgtcatcgcgagcctggaactgccgatatccatttctaaattcattgccgagtcaaatcctaagcttcatgaaagcatgctgaggcacgctttcagaatgacagccatttttactgctttttctactgtcgccgctagtattgcgcttccgtttattccggtatttgatacataccacccgtttattaaagggattgtcatcggcttaattcctgttgtcgcctttacttcaatcgccaggggctactttatgggtgtgcagaaaatggggaagatcgcaattgccaatgtgctgaaaaaaatcatccagctcttgtgcttattcctcttttttcaatggtactcatttgaattggatatggctgtgctggtttccttgtttgttctagtcgtgagtgatgtggtcgtgcttgtttacttatattcacaatttatcatggcaaggcgggcgttatccggccagcagcacattcatttgcgcggaaaggatgtaaggaaaagactgcttgctgtttcaattcctacaacaggactgcgtatttttcatgcggttgtcaatgcaattgaaccctttttagtaaaaggagctcttttggctgcgggcgttgccgggacagcggcgatcgatcaatacggaatgctggcaggagtggctgtgacgatagggtcgttccctgcttttattgcccattcgttaatggtcgtcatgataccgagtatttcggaagcttatgcgctttctcagtatgacatcgtgttaaaaaggctgaagcagtcgattttcattacattaggttacggtatacctgccgtctgggtcatgttccagtttgcgggacctctcacgcatttgttttttcactctcctgaagcgcagtattacctgcagctgttgtggccttactttctctttcatctgtttgtcatgccgctgcaggcgtgcttaatcgggatgggttttgtgaaagaggctttttatcacaatgtatggagccatatcgttgcgctaagtatgatgtatgtactgggatcaatggagaatctgcaaatgctcgggattatccttggaatgaacactggcatgattcttttgacgagcctgcactatgccacgatctgcaaagcattgaaggtatccgtatttcttacgggagggaccagaacgccgcgaattgaaggatgataaaggaacagcaggggcaagctaattgaaaagcatgaaaggaagattccatgttgacgaagcgcttgcttactatatacattatgttattagggttgattgcatggtttccaggtgcggcacaagctgaggaaaaacagcctgctgttcccgctgtttttcttatgaaaacgatagaaggggaggacatctcgattccgaataaagggcaaaaaacaattctccatttttggacgtcatggtgtccgccctgcaaaaaggagcttccacagtttcaatcgttttatgatgcccatccatccgacagtgtgaagctggtaacggtgaatttagtgaattcggaacaaaatcagcaagtcgttgaagactttattaaagcaaacaagctgacgtttccaattgtccttgactcaaaaggggaattgatgaaggagtatcatatcatcacgatcccaacatcatttttgctgaatgaaaagggagaaattgaaaaaacaaaaattggcccgatgacagcggaacaactgaaggaatggacggaagaatagctgagagcatagactctcagcttttttcatatagagaagaagcgaataaacattaatgataattattatcaaaaagaaattaaaataattataattgaaattctcttcgtgcgtgctataataaaggaagacatcaagaaataactgacgataaagctgccttttgggcagcgattttgttttataagagaaatgaagatgatttacgttctcaattagagaggagaattcgatatgaatgaacaagttatcgttcaacgcgactcgcacgagccattgaaaacagacaagagggaaaaaaactgggcacagcacgcggagcttattgcagcacttgtatcaggcgctcttattttggcaggctggctcttatccggatatcaggtattatccataatacttttcttgctggcttttgtgatcggcggatttgctaaagcaaaggaaggaatcgaagaaacactcgaatccaaaacgctgaatgtagaacttttaatgattttcgctgccgttggttccgccttgatcggatactgggcagagggtgctattttaatatttattttttccttaagcggagctttagaaacatacacgatgaataaaagcagcagagatttaacgtctttaatgcagcttgagcctgaagaagcgacattgatggtcaatggtgaaaccaaaagagttccggtttcagacttgcaggccggtgatatgattgtgattaaacctggagaacgcgtagcggcagacggtatcattgaatcgggctcgacaagtcttgacgagtcggctttaacaggtgaatcaatgcctgtagaaaaaaacagaggcgacgctgtatttacaggaacggtgaatcgcaatggctccttgactgtccgtgtcacgaaagcaaatgaagattcgttattcagaaaaattatcaaactggttgaatcagcgcaaaatagtgtttcacccgcgcaggctttcatcgaacgatttgaaaatgcttatgtgaaaggtgtgctaattgcggtggcgctccttttattcgtcccgcactttgcgctgggctggagctggagtgaaaccttctaccgcgcaatggtgtttatggttgtcgcgtcaccttgtgcgcttgtcgcctctattatgccggcggcgctgtccctgatttcaaatggcgcccgcaacggtatgcttgtgaaaggaagcgtctttcttgaacagctgggctcagtgcaaatgatcgcctttgataaaaccggcactgtaacaaaaggccagcctgccgtagagacgattagaatagcagaaggattcagtgaagcggaagttcttgaggctgtctatgccatcgaaatgcaatcaagccatccgctcgcccaagccataacggcgtacgctgaaagccgcggcgtgaatcagtctggctacatatctatagaagaaacctcagggtttggcgttatggcagaagtgtcgggtgcgaaatggaaggtcggtaaagcaggttttatcggcgaggaaatggcagcacaatttttgaaacaaacagcatcagatgtcattcaaagcggtcatacaattgtatttgtgaaaaaggatgatcaaatagcaggctgtatcgcactgaaggaccaaatcaggcctgaagcaaaagaggtcatggaagaactgaaccgacttgggattaaaacggccatgctgacaggagatcacgaagacacggctcaagcgattgccaaggaagccggcatgacaactgtcgtagcagaatgcctgcctgaccaaaaagtgaatgaaatcaaacggttaaaagaagaattcggaacgattgcaatggtgggtgacggaatcaatgatgcgccggcactcaaagcggcggatgtcggcattgcgatgggcggtggaacagatgtagcacttgagaccgctgatatggtcctcatgaaaaacgatttgaaaaagctcgtaaacatgtgccgcttgtctcggaaaatgaacaggatcatcaaacaaaatatcgtgttttctctagctgtaatctgcctgctgatttgtgcaaactttttgcaggtgatggaattgccatttggcgtgattggtcatgagggcagcacgattttggtcatactaaacggtttaagactcctaaaataaaaccagcagcctaatcaggctgctggctttttatgtatcaagctttcccttcatttttgtctttatcagatcttttcataaccaggatgagagcgaggatgcagcaaaggaaacccgctgcacagcctatgatagagctgtaataataaaagcccaccatcttcatcccgataaaaggagcggaaattcccaaaaccgttaagagcataactgcttttcgtctgaaaaaattcatcagcaaacggaacaaccccctgcgattgaacgttactgtcagtatacaggaagaggagcaggaaataaaatgcatcagaaaatgaaggcgtcgtgaaaggcaaacaccggtaaaacctgttacaatggaagacagaacaatgcattgcaaatggcagggaggaacaagaagtgaatagaatacaacgcgtctcttcatggctgaaggaagcggggcatactgccgcatttattcatacgaaagaaaatgttttttacttaaccggtttttacacagagccgcatgaaagattaatggggttatttatttttcaagaagaggagcctttctttgtttgtccaggaatggaagcaggacaggcccgcaacgcaggctggaatcatgaaatcattggctatgcggatcacgaaaatccgtgggagctgatagagaaggccttgaaaaagcgaaatatcagcatacatatgcttgcggtcgaaaaggattcaatctcgctatctcgtgcagaacagctgaagcacgcgacgggcggggctcaatttgtttcagctgaagaaacactcaatcaatttcgcctgattaaagatgacaatgaaattcgtttgctgaaagaggcggcaaagcttgcggattacggtgttgaagtcggcacagccgctttgcgtgaaggcatcagtgaagtggaagtgctcgctcaaattgagtatgagctgaagaaaaaaggaattcagggcatgtctttctctacaatggttttattcggagaaaaatcaggccagccacatggaaatcctggtacagccacgttgaagaaaggtgattttgtattatttgatctcggtgttattcttgacggctattgctctgatattacaagaacgtttgcttacaaaaccatcaatccgaagcaggaggccatttacgagactgtacttcaagcggaaaaagccgcgattgaggcaagcaaacccggtgtgagaatcggagatctggacttaaccgcccgcggaatcattgaaaaagcgggatacggtgactattttcctcaccggcttgggcatggactcggaatttctgtccatgagtatccatcaatgagccaggccaacgatacactgctgcaggaaggcatggtctacacgatcgaaccggggatttatgtgcctgaaatcggcggcgtgcgcattgaggatgacgttcacgtaacaaaggacggggcagttgctctgacccaatatccaaaggaattaatcatactgccgtaataagaaataaaaaaggactttgttctcgacatcgtccttttttatctgcattaaataaaaaaatcatcaaatgttcgaaagggtttaatttcatgtttttggttgagaggttttacagcaagacagctgccaccgagaacagtgagacataacccaattaaaatgaagaaacccatgtgatcttctcctttcagctaaaaacacaaaaagatatctggtacgtccatatcatattgtatgaaacgcattccagatcaagggatttagaaagaagggaatctatggctaatattaaagacattgcagagaaagccggtgtctctgttacaacggtttcccgagtcataaacaatcatccatacgtcagtgaagacaaacgaaaaagagtgtttgaggcaatggaatcattggagtacacgagaaatattcacgctgtacatttgtcgaaaggattttcaaacatgattggtgttgtcttgccgacggttaatctgccatattttgcagagctgattgcaggaatagccgacgcagccgcggaatccggggtacacctctctttattccaaacaaactatgaggtacaaaaagaaatctttgcgctgtcccaattaaagcagcgccaggttgacggcctgattttttgctcaaaggcgcttgctgatgagaaactcatggaatgggagggcccgattttgctttgccagaattcagatattgcccgcttcccaaccatcagcattcctcaccaagaagcatttcggaacggcttggactatttaattgccaaagggcacaaaaaaatagctatctgtttggcaagaaaaaaaggcatgaacagtcattttcgaatcaaagcctacaaagaggcattggaagagatcggcgaggcatttcgtgaagactgggtaattgagaaagcgattacaatcaatgatgggaaggcgctttttcataaatggaatacgtggaaggaaaagccgacggctatttttgttgccaatgaccaagtctcagcagggctttttcttgaagcaaagaaccagcgggtgtcagtaccggatgagcttgcaatcttaagcgttgataaccacgaaatcagccaagcgcttgggatcacaacgatcgatattcagacaagggaaatgggaaagcaggcatttgccatactggaaaaaagaattcaaggacagccgattgaaaggaaagttctggattaccgtctcgtcgaaagatcgactgtttagtgaatgcattgaaaaaaggtttgacgtgcattctgttcgttatgtacgatatgaggtattgaatgacaaaggagctgaggatcgtgaatgggtccttcacagtgaaaaaggtactgaataataacgtattaattgcttctcatcataaatacagcgaagtcgttttaatcggaaaaggtattggtttcggaaaaaaacaagatgatgtcattgaagataaaggctacgataaaatgttcattttaaaagacgagaaggaacaaaagcagtttaaaaagctccttgactatgttgatgaaaagctcgttgatatttcaaacgatgtcatctatcacataagcaataggactaatcactcattaaatgaacatattcacattgcgttgacagaccatatcgcatttgcgatcaaaaggcagcagcagggatttgatatgaaaaatccatttctaatggagactcagtcactatatcctgaggagtaccaaattgccaaagaagtcatagatatgatcaatgaaaaagcgggaatctgccttccggaaggggagattggttttatcgctctgcatatccattcagcgttgacaaaccgtccgctgtccgaggtcaatcagcactctcagctcatggcgcagcttgtcgaggtgattgaagactcatttcaaatgaaagtaaataaggaaagtgtcaactatttgcggctgatcaggcatatcagatttacaatagaaagaattaaaaaagaagaaccgactaaagaaccagaaaaattaatgttgttattgaaaaatgaatatccgctatgctacaatacagcttggaaattgattaaaatcttgcagcaaacattgaagaaaccagttcatgaggcggaagcggtttatctgacgcttcatctgtaccgattaaccaataaaatttcataaattcagtttatccttataacgtgttactgattcgatcaggcatgagtgattgagggaaaaaaacgggaagttcattctcgttcttttgcgcacccaattttgctcatgcctttttgttgtgtaaaagggcaaatgtaaacggttaaactggaagacttacgcctgtgaattcgttgtcatgatttttagctgtaaggtcagactagtaaaaagaggaggtcaattcttatgtttaaagcattattcggcgttcttcaaaaaattgggcgtgcgcttatgcttccagttgcgatccttccggctgcgggtattttgcttgcgatcgggaatgcgatgcaaaataaggacatgattcaggtcctgcatttcttgagcaatgacaatgttcagcttgtagcaggtgtgatggaaagcgctgggcagattgttttcgataaccttccgcttcttttcgcagtaggtgtagccatcgggcttgccaacggtgatggagttgcagggattgcagcaattatcggttatcttgtaatgaatgtatccatgagtgcggttcttcttgcaaacggaaccattccttcggattcagttgaaagagccaagttctttacggaaaaccatcctgcatatgtaaacatgcttggtatacctaccttggcgacaggggtgttcggcggtattatcgtcggtgtgttagctgcattattgtttaacagattttacacaattgaactgccgcaataccttggtttctttgcgggtaaacgtttcgttccaattgtaacgtcaatttctgcactgattctgggtcttattatgttagtgatctggcctccgatccagcatggattgaatgccttttcaacaggattagtggaagcgaatccaacccttgctgcatttatcttcggggtgattgaacgttcgcttatcccattcggattgcaccacattttctattcgccgttctggtatgaattcttcagctataagagtgcagcaggagaaatcatccgcggggatcagcgtatctttatggcgcagattaaagacggcgtacagttaacggcaggtacgttcatgacaggtaaatatccatttatgatgttcggtttgcctgctgcggcgcttgccatttatcatgaagcaaaaccgcaaaacaaaaaactcgttgcaggtattatgggttcagcggccttgacatccttcttaacggggatcacagagccattggaattttctttcttattcgttgctccagtcctgtttgcgattcactgtttgtttgcgggactttcattcatggtcatgcagctgttgaatgttaagattggtatgacattctccggcggtttaattgactacttcctattcggtattttaccgaaccggacggcatggtggcttgtcatccctgtcggcttagggttagcggtcatttactacttcggattccgatttgccatccgcaaatttaatctgaaaacacctggacgcgaagatgctgcggaagaaacagcagcacctgggaaaacaggtgaagcaggggatcttccttatgagattctgcaggcaatgggtgaccaggaaaacatcaaacaccttgatgcttgtatcactcgtctgcgtgtgactgtaaacgatcagaaaaaggttgataaagaccgtctgaaacagcttggcgcttccggagtactggaagtcggcaacaacattcaggctattttcggaccgcgttctgacgggttaaaaacgcaaatgcaagacattattgcgggacgcaagcctagacctgagccgaaaacatctgctcaagaggaagtaggccagcaggttgaggaagtgattgcagaaccgctgcaaaatgaaatcggcgaggaagttttcgtttctccgattaccggggaaattcacccgattacggatgttcctgaccaagtcttctcagggaaaatgatgggtgacggttttgcgattctcccttctgaaggaattgtcgtatcaccggttcgcggaaaaattctcaatgtgttcccgacaaaacatgcgatcggcctgcaatccgacggcggaagagaaattttaatccactttggtattgataccgtcagcctgaagggcgaaggatttacgtctttcgtatcagaaggagaccgcattgagcctggacaaaaacttcttgaagttgatctggatgcagtcaaaccgaatgtaccatctctcatgacaccgattgtatttacaaaccttgctgaaggagaaacagtcagcattaaagcaagcggttcagtcaacagagaacaagaagatattgtgaagattgaaaaataagggtgttagtacgccgtgcttgtcagatgacaagtacggttgtatgatataatattgtgaagtaataaagctttaagttaaaaggagaatgataaaaatggcacaaaaaacatttaaagtaactgcagattctggaatccatgctcgtcctgcgacagttcttgtacaaactgctagcaaatacgacgctgacgttaatttagaatataacggcaaaacagttaaccttaaatctattatgggtgttatgtctttaggtatcgctaaaggcgctgagatcacaatctctgcttccggagctgacgaaaacgatgctcttaacgctttagaagaaacaatgaaaagcgaaggactcggcgagtaatgcaagaattaaaagggattggtgcttcagccggcatcgcgattgcaaaagcataccggcttgaagagccagatttaacggttgaaaagaaaaacatctctgattctgaagcggaagtaagccgttttgatgaagcgattgcacgttcaaaagaagagctcgaaaaaatcaaagagcacgctttgaaagaactgggtcaggataaagctgatattttttctgctcaccttttagttctcagtgaccctgagcttctgaaccctgtgaaagaaaaaatcagcactgattcagtgaacgctgaattcgctttaaaagaaacgtcttctatgttcgttaccatgtttgaatctatggacaacgaatatatgaaagagcgtgcggcagatatccgcgatgtaacaaaacgcgtaaccggccacctgcttggcgtcgaaattccaaacccaagcatgatctcagaagaggttattattgtagctgaagacttaacaccgtctgacacagcccaattaaaccgtgagttcgtaaaaggattcactactgatatcggcggacgcacatctcactctgccatcatggcacgttctcttgagattccagcagttgttggaacgaaagcggctacaggcacgatccaaaacggcgtgactgttatcgttgacggtatcaatggcgatgtcattattgacccatctgcggaaactgtaaaagagtatgaagaaaaacataatgcttatttggctcaaaaagctgagtgggcgaagcttgtcaatgaaccgactgtctcaaaagacggacatcatgtagagcttgcagcgaacatcggtactcctgatgatgtaaaaggtgttcttgaaaacggcggagaagcagttggcctttaccgtacagaattcctttacatgggaagagatcagctgcctacagaagatgagcagtttgatgcttacaaaacggttcttgagcgtatggaaggaaaatcagtcgtcgtgcgtacacttgatatcggcggagacaaagagcttccttacctgcagcttcctaaagaaatgaacccgttcctgggatatagagcgattcgtctttgccttgaagagcaagaaatcttcagaacacagcttcgcgcgctgcttcgtgcaagtacatacggaaacttgaaaatcatgttccctatgattgcgacagttaacgaattcaaagaagcaaaagcgatccttcttgaagagaaagaaaagctcgtaaaagcgggacaggctgtatctgacgatattgaagtcggaatgatggttgagattccgtcaactgcagtcatcgctgatcagtttgctaaagaggttgatttcttcagtatcggaacaaacgatttgatccaatacacaatggcagctgaccgtatgaatgaacgtgtatcttacctgtatcagccatacaacccggcaatccttcgcttaattacactggtaattgaagcagcacacaaagaaggaaaatgggttggcatgtgcggagaaatggcaggagacgagattgcgattccaatccttctcggcttaggcttagatgagttctcaatgagcgcaacgtctattcttccggcaagaacacagatcagcaaattgtctaaacaagaagctgagtcattcaaagagaaaatcttatctatgagcacgacagaagaagttgtcgcgttcgtaaaagaaaccttcaagtaatgtacaaaaaccagacggcctccggcctgtctggtttttttcataagtaagggtatagaaggacacaataacatggctaggagggatagtatgtcaaaccaatttaacgcaggagatactgtttatgtgatctacagaaatccgcacgccgccaatgtagcccacataaaggaagccgaaattgtgcaccatccataccatgaaggcgagctttccctgtttatttatgaaacctatcatccgttcgcagaggacgatgctgtgtttgcaagctatgaagaagctaaatcgctttacaaagaactctttgatattgatccgtatgagtaacaaggaaatcattacaactcatatcctttccgcctagtgagaaaagtaacgttagtaaaggaaaaggatgtggcatcatgcagaacccatttgttccgcagcttgtatatatagaaccgagggcgctggaatatccgctaggccaagaattacaagaaaaatttgagaatatgggcattgaaatcagagaaacaacatcccacaatcaggtgcgtaatattcctgggaaaaatcatcttcagcaatatcgcaatgcgaaatcaactttagttatcggtgtccggaaaacattaaagtttgattcatccaaaccctcggctgagtatgctattccgtttgcaacaggctgcatggggcattgtcattactgctacctgcaaacaaccatgggatcaaagccgtatatcagaacttatgtaaacgtcgaagagattttggatcaggcagataagtatatgaaggagcgcgcaccagagttcacaaggttcgaggcatcatgtacgtcagacattgtaggaattgatcatctgacacacacgctgaagcgcgccattgaacattttggccaaagtgatctcggaaagctccgatttgtaacgaaatttcatcatgtcgatcacctattagacgcaaagcataacgggaaaacgagattcagattcagtattaatgccgactatgtgattaaaaactttgagccgggaacttcacctcttgataagcggatagaggcggcagtaaaagttgcaaaagcaggctacccgctaggctttattgttgctccgatttatattcatgaaggctgggaagaaggatacagacatctgtttgaaaagcttgatgctgctttgccgcaggacgttaggcatgacataacgtttgaattaattcaacaccgttttacaaaaccggccaaacgagtgatagagaaaaattatccgaagacgaagctcgaattagatgaagaaaagcgccgttataaatggggacgctacgggatcggaaaatatatttatcagaaagatgaagagcatgcacttcgagaagcacttgaatcctatattgatacctttttccctaacgcgaaaattgaatatttcacttaaacgggctgttgtgatcaacagctctctttttataaaaaggatttttccattccatcaaaacgccgtaattcaatgattctttatcctctacataattgcttactacacgaataggtgaacgcccgcaacggaggagaaaggacagcacagggtcgtttttcctgccttccatcacatcttcaacgtactgaacagcactgatctcgtgtgcgtatttatgatataaaggaatgcggccgccgccgagaaggcgctccagtctcttatcaacagtcagctcatacatcgtattcatcagccattttccgattccaagctttcgataatgaggagaaacagaaatatccactacatataaagtatttccataaggttcatggtttttaatcgatccgttgtctgttgcttgtgcccatgtatggtcaggagattcaggctcaaattgtacaataagagcagtcatggaaccgataattctgccattgatgagcgcgcataaagcgccttctggaaaggttttgatatggctggcaagctggtcctctgaccacagcaattcctggggaaacggaggaggaaaacattctttttgaagagaaatcagcctctcgatgtcagtctcagtgtagtttctgatggtcagagcctcaaattttctgccgtcgtgcacatacatttgttttagtatgatcatcactctccttatgttgtttcattataacgaaaattgaattttcagtaaatatattctgattttcttataatttattttttgattattcatttttcaaacgaaagggccgatatagaaattaggaggggattggtttgtttaaaaaacttcacatgaagattgctgtttttgtttcgattatgttaatcgtcacagttgttctattaatgctgtcttcttatttgacgctaaaaccgatgattacagaggatgggaaaaatacaactcaaaacgtgacgcagtcacttgaacaaaatattgaattgcaattaaagagttatgccatttcgttatcaagattggctaatggggaattaacgcatacatttgtaaagaaaccaagtaaagaagctgctcggctgtttcacgatgacattaagcaaatcaaagacaacgatgattatgttgcgatggcttacataggcaccgcaaaaaaagaaatgtttacatatccaaaagcggatttcgctgaggattacgatccagcatcaagaccatggtataagcttgcagctgaaaccccggatcaagttgtttggacggaaccttataaagatgtcgtgacaggagacatgattgttactgcatcgaaagcgatcttagacgggcaaaaagtgataggggttgccagctatgacttgaaactctctgctatccagagtatggtcaataaacaaaaggtgccttacaaaggatttgcctttttagctgatgcgagcggcaatcttttagcccatccgtcaaatcaaggaaaaaatatatcaaaggatcaaacactgcaaaccatcacatccgagaaaaaagggatacaagatgtgaatgggaaaatggttgtgtaccaaacgattggagagacaggctggaaggtcggaacgcaatttgataccgatcaattaatgtggatttcagataaaatgaatcgggcaaatctttggatatcattgattgcgcttatcacaacaattattctcagctacttcctggccaaaacgataaccggtccgatacagcagctgatcgcaaaaacgaaagctgtttccgcaggcgatttaacagtgcgcgcggaatcaaaatctaaggatgaagtcggtattttaacaagagatttcaatctgatggttgaaaatatgaaggaaatggttgagcaagtgagactctcttcagggaaagtatctgacacctctgaacaactaacggctgtctctgccgaaactaatgaaacaagcggacaaattgcaaaagcgattgaagaagtagccgcaggggcatcggaacaggcttctgaagttgaaaccattaatgaaaaatcggaaagcctgtcaacgaaaatcaggcaaatcgctgaggaggcaggcggaattaaagaacgctcaaaatcgtccgaggatgcaagctataaaggacttgacgcgctcggccagctgctgatgaaatcaaacgaagccaatatggagacgaaaaaggttgaaacgatgctgctggatttggaaaatcaaactaagaatattgaagaagtcgttacagcgatttcaaacatatctgatcaaaccaacttgcttgccttaaatgccagtattgaggcagccagagccggagaaagcgggcgcggttttgccgtcgtagccgatgaagtgcgaaagttagctgagcaatcagccctttctacaaagcatatcagcgagactgtgaagcttatccagcttgagacaaaagaggcctctcacgcgatggttgaggcaagcagaatgaatgatgaacaaaacagtgccattcacgaaactggagaggtattaaatacgataactgcagaaatgcagtcactggtacaaggtattgatcacatttacgcggaaattcaaagaatgagtgaagaacagcttgcgatttctgaagctattcaaagcatttcagccatatcacaggaatcagctgccgcagcagaggaagtgaacgcatcaaccgatgaacagcttgtcacccttgataaagtcaaacactcaacggaaacactaaagcatgcaagccaagagcttatgaacacaattgcaaaattcacattgtaatccaattacatccccaaacatcatttgttttggggattttttattttataagatgaatagatatggtagtctaaaaaatgaagggaaaatgataaattttaactaaaatcaaaacgaaacatctgggaggaatgaccttgaaaaaaacaattggttttatcggtcttggagtgatgggaaagagcatggcatcacatattctgaatgacgaccaccctgttttggtgtacacccggacaaaagaaaaagcagaaagcatacttcaaaaaggcgcgatctggaaagatacggtcaaagatctttcgaaagaagcggatgtcatcattacaatggtcggctatcccaatgatgttgaagaagtgtatttcggaagcaatggaattattgaaaacgcaaaagaaggcgcatatcttattgatatgacgacatctaagccttcgcttgcgaagaagattgctgaagcggccaaagaaaaagcattgttcgctttagacgctcctgtttccggtggagacgtcggtgcacaaaacggaacactcgcgattatggtcggtggagaaaaagaagcttttgaagcctgcatgccgattttctctttaatgggagagaatattcagtatcaaggaccggctggaagcggacagcataccaagatgtgcaatcagattgcaattgcagccggtatgatcggtgttgctgaagcgatggcttatgcccaaaaatcaggcctagagccagaaaatgttctgaaaagcatcacaacgggcgcagccggaagctggtcattgtcaaatcttgctccccgtatgcttcaaggcaactttgaaccgggattttatgtgaagcattttattaaggatatgggaattgcactagaggaagcagaattaatgggggaagaaatgccaggcttgtcgctcgcaaaatccttatatgacaagctagctgctcaaggtgaagaaaacagcggaacacagagtatatataagctttgggtgaaataaaaggactgcttgtatcctgcaggcaaccatcaggctgtcgtgaaaatctcgatagcctttttttggactataagtgcgtaaaagagaaaaataccacttgttttaattaattgacaaaacggaagggtgaaaataagaacatgattctataattctagctttaagaaagaatcaatagcttaacctatacattcaacatcagtgactatttttctgatgatctaaatgcttatttgttttgtttattgatttattctctgagataggattatgggggaatattcttattactaaagcggttttggagtgaagtcgatttagcattgcctcctatctcagaaaagtgagtataggaggctttttttgtagattattattgatgggggtattgatatgaagcttgaacagcaagaaataaatattttacattctgattctggtccatacgggatagccatttcacccgaaggaaaggtatggtttactcaacataaagctaacaagatcagctgtcttgataagatgggccaaatgcaagagtatattgttccgacacctgatgctggagtcatgtgtttaacggtgtcttcagaaggtgatatttggtttacagaaaatagggctaataagatagggaaactgacagcaaaacggcaatttatagaatatccattgccgcatcaacattcagccccatatgggattacggaaggtccagacggagatatctggtttactgagatgaatggaaatcgtataggtaaattgacattagagggcaaaattcatgaatacgaactgcctaatgaaggatcgtacccttcttttattacgttgggttcagatcactcactttggttcactgaaaaccagaataatgctatcggtaaaataactgaatcaggtgagttaacggagtttccgattcctacaccagcagcaggaccggtaggcattacaaaagggcatgatgatgcactttggtttgtagagatagtgggtaataagataggtaagattacggtttccggtgacataactgaatatgatatccctacaccaaatgcacggcctcacgctatcgctgcaggtgtaagatctgatttatggtttaccgaatgggggggaaataaaatcggaaggctgacaagtgatcaaacaattgaagaatatacaatcaacacacctcatgctgagcctcatggaataggatgcgataatgatggcacagtatggtttgcattagaatgtaacaaaatagggaaattaaaattaactaaataaaggaaaagaggatcctttgcatctcatgcgaaacctatgttgctcaacctgacccaaacatttctcctttattataaaaagtcaaatctatcaatggcataaatctgttgcagcagctttgctattgaaggtgaaagaaaaacggattgtagtgaatatgttcccttcgcagccggatgaagaagactgccgtaacttgaccttgcttggctgggggtctggcagcttttttctgtttctccatacatttagatgaatacaaaaaaagcttgtagaaaaaacatggttttctctacaagctgaagattacctgtatcgtacaggattattttccgatgaattgttgtgtccagatgcttccagactcaacgtagccaacaccgatgtgagtaaagttagggtttagaatgttttttctgtgtccttcactgttcatccaagcttttactacttcttctggtgtcttttggcccttcgcaatgttttcacctgctgttttgtagctgattccgaaagatttcatcatatcaaacggtgagccgtatgttgggctttggtgatcaaagtagtttttgtccttcatatcctgagattttgctcgtgcagatttgcttaacgtttcatcaatttgaagcggctttaagccttgtttttgtctttctgcatttgtaagctcaacaacttttttctcatatgcacttacagatgaaggtgcagatgtcgttgtgtttgttttttcagcagttgcaggtgctttagaagcagtgttttgatcagcagctgctttttcagtagtcttttgtgcaggttttgccgtttctgtcttttgaacatcctgaactttcacgttagattgcttcgcatgtttttgaagaaactgcttaatctctttttcgtttgcagcgtttaacgttttgatatttgtgttaatatgcagttttttcactgcatcgttaagtgacatgttttgtactgtgttccccgtttttactgtaaccacaggctggcaggagagttctttcgctgatgcttgctgtacgcccccgaatgtgaataatccaaccgcagcggcagcagataaaataaatgctttcttcattagttcgtaacctcctagagttgtttgtttctacagaaaaatcataacatagcttttttgtcataaagattccagcactttcctttgacaaatagagattgtcattttcgtaaagtaaatccgttgaatcactaagaataagggaatcagcggtatatatgattttatcgtaccgttacatatcttccttttttttgaaccgttagttatattttaatgtgtttttatattgacagctttttttactccttttcgctgtaacaactattacaaaggtgttacaattaatctcagtatatgtaaatatattgaatgatttgagaggggtaaccagaagtgactgaaataggacgtgaaccaaagaaaaagagcaaaggaaacagagcaatcagaatgaacctttttttcttagctgtctttgttctattcactgcattaatttttaagctcggggttgttcaaattgttgaaggcgaacagcatgaagaagacgctgagaaatcaaatgcaaaaacagcttactatcctgcgcctcgcgggaagatgtacgacagaaatcagaaagttgctgtcgataaccagagcgttccagaaattgtgtatgtatcaacatctagcacaaaaacagaagataaaatcaaaacagcgaagcggcttgcttctttcattcatattgataccgaatttttgaaggaaagggatcttcgtgattactggatcgcagctcatccgaaaaaagccgccgctctgcttaaggaatcagaaagcaatctgaaaggagaccaggcttacaagcttcaaatagagcgtgttccggatcaagaattaaaggctattcagcaagatgacgaagaaatggaaactgctgcgatatatactaggttttcaagcggaaatgcttacgaacctcaaatcgtaaaggcaatgaatccaaataagagcaatagcaatggaaaaaacggagcgctgcttgatgagaagaaaaactcctcgcaaagaccaaaaaatgacttaacatatgatgaaatttccattgtttctgagcatttagaagaacttccgggaatcgatatcgtaaacgattggacacgaaaatatccttatgacaaaaccctttattctgttttcgggggcgtcacgacacctgatcagggcctgctgagcgaccggaaagatttctacttaacaagaggctatgcgaataatgacagggtgggaaaaagttatttagagtatcaatatgaagaatatttaaattcgcataaagaaaaagtggaatacgtagaagataataaaggaaatgtcgtcagccaaaaaaccattgataaaggcagcaggggatacgatcttcagcttgcttttgacatggagcttcaggcaaaggtagaaaagatcattgaagaagaagtaagaaacagccgtgcacgcggaaattacatgcttgacagagcctttgccgtgatgatggacccgaataacggcgatattttatcgatggcaggcaaaaagatagatttaaaaaccaacaaaattgaagattatgcgataggggcatttaccacccaatatgaaatgggatcagcagtaaaggggccaccgtactagccggctatcaggacgggatcccgcattataaatattttgttgacatgccactgtattttgcaggaaacggtaataagcctaagaagtcgtatatgaatatgggaactattaatgaattaacggcattgcaaaaaagctcaaacgtatacatgtttaatgtcgccatgcacattgccggtgtcacatacaagccgcatggacctcttcctgctgaccagaaggatttaaacaaaatgagaaattactacagccaatttggcctgggagtaaagacaggtatcgatctgccgcaggaatcagccggtatgcaaactacacctgatgcggtaggggggttaattttagacttggccattggacaatatgatacatatacaccgcttcaaatggctcagtacatctcatcaattgccaatgggggtaccgcattcagccaagaattgttacaagtgttcatgagcccagcaaaaaagaaggccttgggaagaccattgaacaaagaaagccaaacattctcaacaaaattaacaactcagaaagtgacattcagcaggtgaagactggaatgaagctagttaccacttcgggaacagctagaaatacgtttgcagaggatgtttccggaaaaactggaactgctcaaacattttattacggaacaaatcgtaattggtggggaaaaagcacgtacaatctaacatttgtcggctattatccatcaaaaaatccaaaagtggcattcagtgttgttgtcccttctgtagcgaacgaccacgacccgatcaacaaactcattgccaaaagagctatccacgcctacgcagagctcgaaaaaaaacacagtaaaaaataaaaaacagggtgcacaactaaaagattgtgtgccctttcttttattcaaaaattgacgttcaccataagaatagaaggagaatactcattttctagcgaatcatactaggtaaaagtcaatctgtatatgtcgaaacacgatgatcatgcaaaggagggattctgtggaacaggatacgcagcatgttaaaccacttcaaacaaaaaccgatattcatgcagtcttggcctctaatggacgcatcatttatatatctgccaactccaaactgcatttgggctatctccaaggagagatgatcggatcattcctcaaaacgtttctgcatgaggaagaccaatttttagttgaaagctatttttataatgaacatcatctgatgccgtgcacctttcgttttattaaaaaagatcatacgattgtgtgggtggaggctgcggtagaaattgttacgacaagagctgagcggacagaacgggaaatcattttgaaaatgaaggttcttgaagaagaaacaggccatcaatccctaaactgcgaaaaacatgaaatcgaacctgcaagcccggaatcgactacatatataacggatgattatgaacggttggttgaaaatctcccgagtccgctatgcatcagtgtcaaaggcaagatcgtctatgtaaacagcgcgatgctctcaatgctgggagcaaaaagcaaggatgctattattggtaaatggtcctatgaatttattgaagaagaatatcatgatatcgtgaaaaacaggattatacgaatgcaaaaaggaatggaagtcggaatgattgaacagacgtggaaaaggcttgatggcacacctgttcatttagaagtgaaagcatccccgaccgtctacaaaaaccagcaggctgagctgctgctgctgatcgatatctcttcaaggaaaaaattccaaaccatcctgcaaaaaagccgtgaacgatatcagctgctgattcaaaattccattgataccattgcggtgattcacaatggaaaatgggtgtttatgaatgaatcgggaatttccctgtttgaagcggctacttatgaggacttaattggcaaaaacatatacgatcagctgcatccttgcgatcacgaggatgtaaaagagagaatccaaaacatcgccgagcaaaaaacagaatctgaaattgtcaagcaatcctggttcacctttcagaacagggtcatttatacggagatggtctgcattccgacgaccttttttggtgaagcggccgtccaggtcattcttcgggacatttcagagagaaaacaaacagaagaattgatgctgaaatcggaaaaattatcaatcgcagggcagctcgcggcgggaatcgcccatgagatccgcaaccctcttacagcgatcaaaggatttttacagctgatgaaaccgacaatggaaggaaacgaacattactttgatattgtgttttctgaactcagccgtatcgaattaatactcagtgaactgctcatgttggcgaaacctcagcaaaatgctgtcaaagaatatttgaacttgaaaaaattaattggtgaggtttcagccctgttagaaacgcaggcgaatttaaatggcatttttatcagaacaagttatgaaaaagacagcatttatataaacggggatcaaaaccaattaaagcaggtattcattaatttaatcaaaaatgcagttgaatcaatgcctgatgggggaacagtagacattatcataaccgaagatgagcattctgttcatgttactgtcaaagacgaaggggaaggtatacctgaaaaggtactaaaccggattggagagccatttctaacaacaaaagaaaaaggtacggggcttggattaatggtgacatttaatatcattgaaaaccatcagggagttatacatgtggacagccatcctgaaaaaggcacagcgtttaaaatttcatttccaaaaaaataaaacaacggcttaaacgccgttgtttatcgtcttcattgcttcacgtttttttaatacaaataattctaaacggtccaggccttctctcagtgtgtccagcgagtacgcaaaagacaatcttacatatccttcaccatatgttgagaacgagctgcccggcacgagtgccacaccagcgtcttccaaaagagccatactaaaatcaaatgaagtcattccaaatgatttaatagaagggaagatataaaacgcaccggacggtttaactacatcaagtcccatggaaacaagacggtcataaacatagtcgagacgttttttgtattgttctctcataatcaatgcgtcgtcaaagccgtttgtgacagcttcaagcgcggctttttgagaaatggatgaggcacatgacacattgtattgatgaacctttaaaatgtgctttgcaatgtctttcggtgcaaataaaaatccaattctccaaccggtcatgctgtgtgattttgacaagccgttaatgacaattgtttgatcccgcaaatggtttgcgatggagtaatgcggtctgtcatatgttaattcactgtatatttcatcggacaatacgaagacatttctgccttttaaaagggctgcgatgcttttcagttcttcttcagataaagtcacgccggtaggatttgacggataaggaagcacgacacacttggtgttgggtgtcagagcatcttcaatcagccgggcggtaagcttaaagccgtgtgatgtagtatcaacaatgacaggcttggccccgcacaaattgataataggttcatagcccggataaataggccctggcataatgacttcatcaccgggagataaaatcgtccggaatgcagcatcaatggcttggcttgcgcctgttgtgatgatgatttcagattcagcatcatagttgaaatccgcttttttcttcatataaagctgcacagcttgtctcagctccaggtagccggcattcggagtatatgacgtcacgttttcatcaatggctttttttgcggcagctttcacatgatgcggtgtgaaaaaatcaggctggccgattgtaagtgaaatgacgtcttcgtgttgggctacaagattcgagaatttgcgtattcctgaaatttcgatctctcttgctttcggattcagcaaatgttccataattcatcaccttaacaaatataatgagtttatcctattttaccactagctgatcatttgtcacctttttaactgatatatttcgattgtatgcgccttttttctaaacatacctttcttttcagaaaaaaagaagacaaccagcgatttgattgtctttattgtatcatgttctattattgtttatatgtgccaatttcattaatagccataatcaaaatgaaggtcttcgtgccaaatcagatacggaggatgctcttctcgaaggtcagctgattctttcttcatattcaggtaagtttcttcactgatatcctctaaaacagtcatttcgttttctttaaatattactaaggtacccattatttacacccttctttggaaaaatccttgactattttatcactgttagttggaaagtcaatggttattaggaaaaaagtttcttttttgaggaactcggcttgttgccttcggaattcgattttgaagagctgccattcactttttacaaattacgccgatatatacagtacaatactgaatgcgaatagcgagggattgaattgtcgttacaacaatacgaaattttattggattctggtacaaatgaattagaaattgtgaagtttggcgtgggtgaaaatgctttcggaattaacgtcatgaaggtaagagaaattattcagcctgtcgaggtgacatcagtgcctcactcccatcagcatgtagaaggaatgattaaactcagaggagaaatcctccctgtgatcagtctcttctcattttttggagtagagcctgaaggatcaaaagatgagaaatatatcgtgactgaatttaataaacggaaaattgtttttcatgtcggctctgtttctcaaattcacagagtatcctgggaagcgattgaaaagccgacatcgttaaatcaaggaatggagcggcaccttaccgggattattaagctcgaagacctgatgatctttttgcctgactatgaaaaaattatttatgacattgaatcagattcaggtgtggacacgtataatatgcataccgagggcttcgatgaaagaagaactgataaaaagcttatcattgtagaggactcaccgcttttgatgcgcctcttgcaagatgaattaaaagaagcagggtacaacaatatcgcttcgtttgaaaatggaaaagaggcatatgaatacattatgaaccttgctgaaaacgaaactgatttatcagaacagattgatatgatcatcactgatattgaaatgccaaaaatggacggacacaggctcacaaagctgctgaaggaaaatccgaaaagctcagatgtgccggttatgattttctcatcgttaattacggatgatctgcgtcaccgcggcgaagttgtaggcgcagatgagcaaatcagcaagcctgagatcagtgatttgattaaaaaagtggatacgtatgttattgaataaataaaaacagccgttgccagaaagaggcacggctgtttttattttaaaagtaactctcgccaagttttttaaagaccggtttatggtaagctggctgctggcgatttggcactagcggcttttctttcatgccgacatattcttgcaaaaggtgtttcgcttttgttaaagacatttgagctttaggatttcggtacgattgattaagtgtacctaaatgcggaagatgttcgaagtcttctttagttggaggcatgtgaaaatagtagtctccgattgagataagcacgtccgattgctgttggctgaaccttggattttttgaaaaatgaagccctattttctttcctttaccttctttgacaagcttttgcaaagcccgttttttcagcagatataggtatttagggttgggggcggtttttgcatggcggttcacagtgtaaactgcttttgaaagattttctacggttggctgcagatctttcgtatatgcatggtcgtccattatttctctcctttgctcttatcaatttctatatgtttagattatacttttttaaagttgaaatgcaaatattgaatgtaaaaatgcgcttttttctaagaaaaaaagcgcatttttaacctgcattatacagatcttgccttctttttcggctgttcttgaaatgcttcctgaacattcacttccacagcctgagcactgtattttggcagtgcaataaaataaaaaataaaaacgagcaggataataacacccatgccgtaataaagataatcaatgtttgatacaaacttagggaataacagtgcgactaagccaagtgtcaaagactgtgcaaacatcataaaagggtcttgcatgccgcttacacgtcccatcagttttggatgaacaattttgggcatccaccctccgattgcaatgttgatcggtccgatgcacattcccagtgcaaaagctgccgcgtaatacacccataaaatattggtgtagccgaggacgaagatcagcaaacctgcaatgaaaatcggtatcgacattaaaaagtgcggcttcacttttttagagatgatcgtgcctattacgctgcctgccagaagcccaaacccgagtgcgatcgtaaatacagacgtatgccactcataacggtcaggagccaatccatatttcattgtaaacatcggcaatacagcgaatcctccgttgacaaatccaaaaatgaaaaagccaaaaataagagatgccagcaatttgttttttaaaatatagaggatgccttctctaaagtcatttattgaatccttaacagaagtctttctccagctgaatgcaccgtttggctgtcgggcttcttttggaatccggcagctgcggatcagcagcccggaaatgataaagctgacaaaatcaagaataatggcgccttcaataccgatggtgttgtacataaacgcgcctataccgactccaaacaccataaaaatgctaaaaagcatctgattaagccctgccgctttcgcataatgctccttcggcagaatggcttgtaccaaactgttttctgccggaaagaaaaactttgttacagcgcttctgataaataagatacaaaaaacaagagggatattgccggtaaataaagtgaaaaaaagcacgacagtcaggcctgctctgatccaatcacaattttctgccaccttttttctgtcaaaccggtccgcgacgactcccacgatcagaaatacaaatatggtcggaagagaatacatcagctccgccaaggtcgtatatgaaggctggctgctgaatcggtccagcaaaaaaaaagcaaaggccatgttgcctactgtcgtgcccatttgagaagcgagtgctgcgaaaaatagacgaacaaaattacgatttttaaatatatccataaaaacgctccttaccctaaaggtcccactttatcatattataaaccgcctgtttttgaaacaaataagaaaacattaccggttaatcgtgactcttgttccgtttggcacaattgaagcaagttcaatcacgtctttgttatgcatgcgaatgcagcctttagaaacagccttaccaatcgaagcgggattattcgtcccgtgtattccgtagtgctgctttgaaaggctcagccaataagcgccaaatgggccgccgggattgcgctggcggttaataatgtaaaactcgccagtaggcgtttgcgttagtattttaccaacggcgatgggataggttttcattacccgattatttaggaacagcgtaagggtcttcgctccgattgagactgcgatatgatacggaattgtataagggtccggcagtccggggatgactatggactgtcccgctgtgagccctgcctgcagtgacggattagcctggagtaatgcagccgtgctgattctgaaatcagccgcgatgctgttcagtgtatcaccttgcttcacctggtacgtaagcagtttcctcatcctccttttttacttataagtattgatgaggagcccatcctgctacattaatttgtgctttttaaggtgaagacagtgatttcaggcttggccagaaaccgcaaaggcagcctggtcatcccgaggcctcggtttacgtaaatatgagtgctgcccgtttgatacattccctctgtgtagacttttccatatggaggcgtaataatcggtccgtaaaaaggcagctgaatctggccgccgtgtgtatggccggaaagctgaaggttcacgggataatctgttgttttcaaggccgcatcaggttcatggacgagaagaatggaaaaaagtctgtcgctcagccttgaaagggtgccttcataatctgggtttcccagcattaagtcatcaagcgaagcaatttcgattttgctgccatctgcgagtgacaatgtttgatagccattgcgatataccgtgaaacctccggccgtcatcaggcttttgtaaacggcagttccatagcctccgtgatcatgattgccgtaaatacaaagcttgccgaagggagcattaagctttctcaataatggaatgactgcctggtggtgctggtacgtatcaggattatcgataatatcacctgtaaaaacaatgagatcaggtttagattcattaattgtaagaatgacagtttttaaatcttcgagagtaaagtaatcactcaagtgtgcatcgctgaactgcacgattttaaaaccgtcaaatccgtgcgggatgagagagctttttattgtgtgttcggttgtctcgatcatatgcggctcgagatacctggcatagccatatcccccgccggccgttaaagccccggcagcaagagcgccgaacattccttttagaaattgtcttctggacatctttttcatttcaaaccaacctttaatagagtttttctattatatcatctgtatctgataaaaatctcatatgagcatgtgctgacagaggcagggatataatgatagaatattattgaatgaatactcattcacaattggagggataaacatggaaaaaaaggcggtaattattaccggcgggtcaagcggcatgggaaaagcgatggcaaaaaaacaggctgaattagggtggcacgttatggtgacagggaggaaccatgaagcacttgaggaaacaaaaaaagaaattcagacctttgagggacaggtcgcttgttttcaaatggatgtccgttccgattccgccgcttcagacatgattaaagaagcgttaaaagcctttggccggtttgacgcgctgattaacaacgcggccggaaactttatttgtccggcagaaaagctgacgcccaatggatggaaagccgttattgagattgttttaaacggcacatttttttgcagccaagcagcggcaaggcattggattgaccagaagcagcagggtgtcattttaaatatggcagccacgtacgcttggggagcgggagcgggggtcgttcattccgctgcagccaaagcgggggtattgtcattgacaagaacgctggccgttgaatgggggagcaaatacggcattcgtacaaacgctatagcccccggaccgattgaacgaacaggcggtgcggagaagctatttgaatcggaaaaagcgatggcccgcacgatgaacagtgtgccgctcggccgattgggcacaccggaggaaatcgccgctttggcagcgtttttgctttctgatgaagcatcctatataaacggggattgtatcacaatggacggagggcaatggctgaatccttatccgttttaaagaatattaatctttggattcaatgtggtataatcagacaaagatagagaagcaggtgataacatgttggatccacttgatattttaacgaacattgatgatgtccttccatattaccaggcgattttcagtgccgaggaacagaaggttgtcggatatgaggtgcttggacgaattttggcagattcagaaatccaaagtctcgggcccttctttttagatgcggggatacccgaagaatataaattagaggttgataacagaattatccgccaggctcttgaccgctttttagaggcggattctgatctgctgatttttatgaatcaggatgccaatctgctgatgctggatcatggtgaaagctttctggagcttctgaaagaatatgaagcgaagggaatcgaactccaccgttttgtgcttgaaattacagagcacaattttgaaggggatattgagcagctctaccatatgcttgcatactatcgtacatacggaattaaaatcgcagttgacaacatcggaaaagaaagcagcaacttggacagaatcgcgctgctctcaccagatctgttaaaaatcgatttgcaggcgctgaaagtgtcacagccgtcaccgtcatatgagcatgtgctgtacagcatatctttattagcaagaaaaatcggtgcggcgctgctgtatgaagacattgaggcgaacttccagcttcagtacgcctggagaaacggaggccgctattttcagggctattacttagtgtctccatctgaaacgtttctagagagagatgtattgaaacatagactaaaaactgaatttcaccaatttatcacacatgagaaaaagaaactggaaaccgtctatgagcactctgaacagttttacaaacgagtgcatcaggctgtgacctctttgagaaaaaacaatctgtcttctgatgatgactttattaaaaagctggcggaagagctgacagattgcagcttcaggatttacatgtgtgatgaagaaggcgatcagctgacgggaaatgtgtttaagcaggatggggaatggatttatcagccggaatatgcggaaaagaactggagctggcgtccttattttctggagaacattatgcgaatgagaaatctcagaaaaggttttttcagtgatctgtacagtgatttggaaacaggtgaaatgatcagaacgttttcatatccgatggatgatcaaatgtatttatttatagacttgccttattcttatttatatgagcaggacggactgatttaacggctgaaaggccgttttttttatgaaatgaaaaaaatatcaaaaaacgattgacattgatactgagaatcattatcatttaattatagagagaagctactctctgttccccaacccctctatcagatcaagatccgaaaaaacttggcgctacccccgccaagttttttatttgtcaaagcataggacaatccaatgaaacaataaacctaactagtggtaaacgtttaacacggggagaaacattgagtgccgaacacccctgacactgctgcacgggtgttcagttccgttgtttacctctatccagcatgactcccattgattatggccacgcggaacttcaccataacattcaaaagaaggttttgacaaagttgcaaaaaggcattcttaatgctgccaaagattcgaaaaaaattataattgtgtgcatgacattcaaaaaaagcctcaaactaaagaaaaatagtttttttcacttttttttctttgcttaaattcagcagtgaaaatgccatcctgtccgactttatggtatgatgctcaatagaacttgtattataataaatacttgttgatttgaagttgctttttgaaaggagtctttttttagaatgtcacaattaatgggtatcatcacacggctgcaaagtctgcaagaaacagcggaagcggctaacgagccaatgcagcgttatttcgaagtgaatggtgagaaaatatgcagtgttaaatatttcgaaaaaaatcaaacgtttgaactgacggttttccaaaaaggtgaaaaacctaacacatatccgtttgataatatcgacatggtttccatcgaaatctttgaacttcttcagtaagattcctgaaatagggggaacaagcttccgcctttgcaaaagtaatcgaaataaacggtaaggaacatacttgtttcatggttgtaaatccttgaaaaggagtgtcgtgatggctgattcttttctgttttataatctttcagaagcacagatgacctttcaagatgtgatggaacggcttaaagcctttgttcaaaaggacccccgttcttcttatgtgttatcgatcggaaccgattcacaggtttaccgcgattacacaaagtttattaccgcattgcatttgcatcgtacaggcaagggagcttggggctgcttgaaaaatcatacagtcgacagacccatacatagccttcgggagaagatttcgttagaaacggcgtacagccaagaaacggccgctcatattcttgatggacacttaatggatattaccgatctgctcctgccctttaccggtgagggggcggatcttacctttgaagttcacttggatattgggaaaaaagggcttacaaaagatctgatccaagaaatgactggacgtattacctccatggggattgaggccaaaataaagccggattcatacactgccttcagctatgcaaatcgtttcacaaaataatttgactgaaaaagccaaggtaaatgtcgaattatgcggttgacgtttgttatctgattacttattctagcggtagagctgaaagtaagttgtcttgctttcagaggtattcagtataaaacagggggcctgattgcgaatgagtcttatcggtgaacgatttacagaagaagaacaaaaacttctgctgaatatcctgatcaaccatgagtatgccatcgagctattaagcagtgagatcaacgatatagagacagggaccaaaaacgttgacggaaccacctacaaaaaacttgtaacgctatacgaccgatttcgatttgaaaattaatgggacaccctataattgatactccacaaagagtatcttttttattgaaaggaaacttttcgacaaatactgataaagtttatattattgcaatatagggaatgtattgatgatgaaaatgaaaaggggtcgaaaacatgataagcttacaatcagatcaacttcttgaggcaacagtcggacaatttatgattgaggcggacaaagtagcgcacgtgcaagtcggaaataaccttgagcacgcattattagtattgacaaaaaccggatacacagccatcccggttctggatccttcctaccgtttacatggcttaatcgggacaaatatgatcatgaacagtatttttggacttgagcgaattgagtttgaaaagcttgaccaaatcactgttgaggaagtcatgctgaccgacattccgcgccttcatatcaatgatccgattatgaagggattcggcatggtcattaataacggatttgtctgtgttgaaaatgacgagcaggtatttgaagggatttttacgagaagagtcgttttaaaggaattgaataagcatatacgctcgttgaataagtaggctgtacggcctatttttattatatagccagagtgaaaaagaaagcgcatacataatttaaacgagaatagggcttgaataagaaactaagattttattagaatgggagataagaaaaacttattgataacaaaaaggaggacgacatgcagcttcaagagcttcatatgctcgtagttttagctgaggaattaaatatgagaaaggcggcagaacggctttttgtatctcagccggctttatctcagcgcttacaaaccattgaaaaggcgtggggaacaaaaatctttttaagatcccaaaaaggattaacggtaacgcccgccggtgagaaaatcattcagtttgcgaatgatgtgacattagagcaggaaagaataagagaaaatattgacgagcttgaaggtgaaattcacggcacattgaagcttgccgtcgcctccataatcggtcagcattggctccctaaagtcctgaagacgtatgtggaaaagtatccgaatgcaaagatctcgctcataaccgggtggagcagcgaaatgctgaaaagcttgtatgaggatcaggttcatatcggcattataagaggcaaccctgagtggaaggggcgcaaagattacttaatgacagatcatctgtatttagtggatactgaaatttcctgcatcgaagatattgcccatacagaacggccgtttatccagtttaaaagtgacagcacttattttcaggaaattcagcactggtggcatcaaaaatttaaaacgtcaccgaaacagacgatattggttgatcagattgaaacgtgcaaacagatggcgctgcacggaatcgggtatgccattttgccgtctgttacccttcaaaatgaagataaagtgaataaaatgcctcttttagacatgaaagggcatccgatcggtcgggatacatggttattaggctatgagcctgcctttgaactgaaacaagtccaagcttttgtacaagtgataaaggatatgctggatcaggaaaatccattttaaagacagcgaggtgctgtctttttttatttatctgttgacaatgaaaatcattatcatttaaagtgatacatatgatattgaaaatcattatcaattaatggggtgataacatggctaaagccttgattacatatgccagcatgtcaggaaatacagaagacattgccttcataataaaagatacgcttcaggaatatgagttggatatcgattgtgtcgagatagatgatgtggatgtgtcttgtttaacctcctatgattatgtactgattggcacctatacatgggggacggcgatttgccctacgaagcggaggattttttcgaagaggtcaaacagcttcagcttaatggtttaaaaacagcctgcttcgggtctggcgattattcttatccaaagttttgcgaagcggtgaatttgttcaatgccatgctgcaagaggcgggagctgctgtttaccaggaaacactaaaaattgaattagggcctgaaacagatgaagatgtggaaagctgccgagcgtttgcgagaggttttcttgcatgggcagattatatgaacaaggaaaaaagccatgtttcataaaggagcaactgctgttacggcatcggcgttttctggatattttgtggcggtacaaggagaaggcatttttcattattctttggagcagggctggagaaagctttttcgtttgaaaagtaagatacactgtatcagctacatagggccttacttatttggcgttggtgaaaagggaacagtcattcgttcggctgatgaagggaaaacctggacgatgtcgagctttccgacaaatgcaacagtgtgggcgattaccggcagaaacaacgggtttgtctgcgcccacggtaagcattgtatttatgtatcggatgattttggtgtctcatggcgcgtagccaaaccttttgccgaatttcataatccccctgttatccggtcgctatgccttcacgggggtaatctttttatcggcacgcaaatacacgcatattttggcggcatttgggcttacgacattaagcgtgacactgtccaagttgtcaaaaaagaaaaaaaccggatgacggcatccatgctcgtgttcaatgaaaattggctggtggcggcgatgggttctgtgaaaggaaagcacggtgctgtcactgtacggaatcttttgaatggtgaagaattcatcattcaatccagtatgatcagaaaagaagagtcatttcttgatctttcagaggatgatggcattatatatgtcactacaacacaagatgaaaacggtttttcgagaatttaccaggctgatctcgaagcccggtcgttaaaatggttcgataccattaagggacatggatggagagtggccaatcagaaagagaatttcttttgcgcaggcttgtatgaatgtaaatttgtccagccgtacgaagtttcagcaatgattcattagaggaggaacaaggaattggcgaagattttgctcgtttatgcaacaatgtcaggcaacactgaagctatggcagatttgattgaaaaggggcttcaggaggcggaagcagaagtagaccgtttcgaagcaatggatattgatgatgcccagctgtttaccgattatgaccatatcataatgggaacctatacgtggggagacggagatctgcctgatgaatttttagatctggctgaagacatggatgagattgatttttccggcaaaacatgcgctgtattcggttccggtgatacagcatatgaatttttctgcggagcggttgatacgctagaggcaaaaataaaagaacgcggtggagacattgtgctgccttcggtaaaaatcgaaaataatccagaaggtgaagaagaggaagaattaataaactttgggagacaattcgcaaagaaaagcgggtgcgctgtctgatcactcactgggaactgctaaaacggctgttcctttttttcttgtctttgtatctttcctttgatacagtaatgaggtagaaaatcaggaggaggactatacatatgaaaatgatggacgcaaatgaaattatttcatttattcaaaatagtacaaaatcaacacctgtaaaggtttacgtgaaaggtgagctggaaggaatcaatttcggcgaatctgcgaaagcttttatcaacggaaacactggtgtcgttttcggtgagtggagcgaaatccaaacagcaatcgaagaaaaccaaagcaaaatcgaagactatgtggttgaaaatgaccgccgcaattctgcgatcccaatgcttgatcttaaaaacatcaaagcgcgtatcgagccgggcgcgatcatccgcgaccaagttgaaatcggtgataacgcagtcatcatgatgggtgcttctattaatatcggttcagtcatcggcgaaggcacaatgattgatatgaacgttgtgcttggcggacgagctactgtcggaaaaaactgccatatcggcgcgggttctgtacttgcgggcgttattgagccgccatccgctaaaccggttgtgattgaagacgacgtcgtaatcggcgcaaatgctgttgtgcttgaaggtgtaacagtaggtaaaggagctgttgttgctgcgggagcgatcgtggtaaacgacgttgagccatacactgtcgttgcaggcacaccagctaaaaaaatcaaagacattgatgaaaaaacaaaaggcaaaactgaaatcaagcaggaattacgccagctgtaaggaaaagtttgataaaaaaggcgtggataatatatccacgccttattcgtataggcaggaggaatagaaatgaagaaagaggagctcatcgcaattcgcagagatctgcatcgtataccggagcttggatttcaggagttcaaaacccagcagtatttattaaatgtcttggaacaatatccgcaagacagaattgaaattgagaaatggcgaacagggctttttgtaaaagtgaacgggacggcgccggaaaaaatgctggcgtacagagcggatatcgatgcgctttctatagaagagcaaactggtcttccattcgcatcagagcatcacggcaacatgcacgcctgcggtcacgatttgcatatgacgattgcactcggcattattgatcattttgttcaccacccagtcaaacaagatttgctttttctgtttcagccggcagaggaagggcctggcggtgcggaaccaatgcttgagagcgatgtattaaaaaagtggcagcctgatttcatcactgcgcttcatattgctccagagcttccggtaggcaccattgcgacaaaaagcggccttctatttgcgaatacatcagagctagtcatcgatctggaaggcaaagggggacatgcggcatatccgcatttggctgaggatatggttgtagcagcaagtacacttgtcacccagctgcaaacgattatctctagaaacacagatccgctagacagtgctgttattacagttggtaccattaccggaggctcggcacaaaatatcattgcggaaacggcccacctggaaggcacgatccgcacgctttctgaagaatcgatgaaacaggtaaaggaacggattgaagatgtagtgaaaggaatcgaaatcggattccgctgcaaaggaaaagtgacatatccgtctgtatatcaccaagtttacaatacgagcggattaacagaagaatttatgtcttttgttgctgaacatcaactggcgacagtaattgaagcaaaagaagcaatgactggggaggattttggctacatgctgaaaaaatatcccggcttcatgttctggctcggcgctgattctgaacatgggcttcatcatgctaagctgaatcccgatgaaaatgcgatagaaacagcggttaatgtcatgacaggttatttttctgtttatgccaattaagtacaaatgaaagaataaaattccataaaatgagcactctagtaaacggaggtgttcaaaaatggctaaaaaaattggaattgaacaatcgttatcagatgtagaagctgctttaaaagaaaaaggatatgacgttgtaatgatgaaaagccctgctgatgctcaaggctgtgactgctgtgtcgtaacaggtcttgataataatgtgcaagggatagccgatacggtaacacaagcacctgtcattacagcttccgggatgacggctgaagaaatttgtagcgaagttgagagcagaattcagtaataaaaaaaccgaagcaaaaagcttcggttcttttatttattctgtttctttagggaaagcgcggtcgaacgcgttctttatttcttttctcaacactcgttcgactcgccactgttccatattttctgttttggcaatgaccctgattacaatttcagaagtccccagttcttgaatcccgatgacatttgggccttcttttatttgtggaagagccgctgccgtttcatcacaaacctgctgtaaaatatgaatcatttcatcaatatttctttcagccggcactttaatgtcaacaagagcctgcatggtaccacgagaatgattgctcacgtttgtgatgtttctgttggggatgtaatgcagtgttccgtcaaagctgcggatttgagttgtccttaagccaacctgctcgacaattccgtcaaaggtggaaacggtaatataatctccgacatccaattgtttctcaagcaaaataaaaaaacctgtcacgatatcactgacaagcccttgggcgccaaatccgacagccaggccgacgattcctgcccccgctaaaagagcgcttggatcataatgaaacaaatctagaaccatgacgaaaaatatgaaaatcaatgtataagcaaatatgttaagagtcaggcttcggagcgtatgtgcacgtccgatagacaagctattctgctcctcgaattttgcaaaaagatgtttaatgattttcatgcctaatgatcgaacgataaaatagagcaatatcataatggcgagtttaatgagcagaacaccggcatttgtaatcagtcccgcccaatcatattgtttaataaagtccatgttgagctccttttctaattgattgctgcacattgagactagttaccctgtacatgaccatgttaaacgttttattcaaaaatgtcgaagccaaagacatacatgatttgttaaaaattgactcgggaaatctgcttttatataatggcattgcgatataactaaaaatggttaatcaccctttattttcatgcgattttgacctttaagccaaacaataaattggagggatacatatggcagaacgtatggtaggtaaacaagctcctcgttttgaaatggaagcagtccttgcaagcaaagaattcggtaaagtaagtcttgaggaaaacatgaaaaacgacaaatggacagtgctgttcttctatccaatggatttcacttttgtttgtccgacagaaattacagcaatgtctgaccgctatgacgagttcgaagatcttgatgcagaagtcattggggtttcaactgataccatccatactcatttagcttggatcaatacagaccgcaaagaaaacggtcttggccagctgaaatacccgcttgctgctgatacaaaccatgaggtatcccgggaatatggcgttttaatcgaagaagaaggtgtggctttgcgcggattgtttattattaatcctgaaggggagcttcaatatcaaactgttttccataacaatattgggcgtgatgttgatgaaacgcttcgtgttctccaggcgctgcaaactggcggactttgtccggctaactggaaaccaggccaaaaaacactttaattctttccaagaacgaaaagcggtctagcatattcgttaggccactatgttaaataggagggaaaaagcaatgaaattacgtcagcccatgccggaattgacgggagaaaaagcttggttaaatggtgaagtgacgagagagcaattgattggggaaaagccgacgcttattcatttctggtccatcagctgccacttgtgcaaagaagcgatgccgcaagtgaatgaatttcgtgataaatataaagatcagctgaatgttgtagctgtgcatatgccccgttccgaagatgatcttgaccttggtaaaattaaagaaacagctgctgaacacgatatcactcagccgatttttgttgacagtgaccatgctttaaccgatgcatttgaaaatgaatacgtacctgcgtattatgtgtttgataaaacaggacagctccgtcacttccaagccggcgggagcggtatgaaaatgcttgaaaaacgtgtgaaccgcgttctaactgaaacggaataggtatctgactaaatagtatttcctaaaaacctgatcacatcaggttttttatttgtgcaaaaagcaatggaagaagagtaagaagcttatttttccaaatttgggtataggaattgatggtttgtttgattgatacgctagaaaacacagctaatttttgatgtttttcctcaattttagataaatctcatatctcataactcgaaaattgtagatattacactaaatttctttaaagaagtaagtaaaatatatattttcaacattataccaaataaactagaaagccccttaatcccttgagaataaaggactcttttgaaaaataaaacattttcagaaaataaggaatttttcatagagtaaatataatagtaaaatgctaaaataatagttgataaaattacttttgtaatctaatatcttaattaaagatgttaattttgataggggtacattgaggaatgtttaatgaaagagaagctttgcgcttgcggttagaacaattaaatgaagctgaagtgaaagtcattcgtgaatatcaaattgaacgtgataaaatatacgcaaaattaagagagctggacagaaatggaagcccttccgaaatcaaaaaggatttccgttctgaaaaaaaacctgactctctgccggttctcgctgagcttgcggctcaggaaatcagaagctatcagccgcaatcacagcagcagtctgtccagcctcagcttcaatctatttcctctcttcctgccggtataccagacggaacaacacgaagaagaagaggaacggcaagaccgggatcaaaagcagcgaagctgcgtgaagctgctattaaaacattaaaacgccacaacgcggcgattaagagctccgagcttcaaaaagagattgaaaaagaaagcggtcttgaaatccctaatatgacaacgtttatgcaaagcttaattaaaatgtacccggaagtgaaaaaaccatatcgcgggcagtacattttagagggtgaaatcgaatctgcagaatcagctgaatcagctaatgaataaatataaagaaaaactgcttggcatcgctcaagcagtttttttattgaggttttttctgtgaaggtttgttttctttttcaagattaagcttatacacccacttttgataaggcttttcttcagcggctctgtttttcagctcttcgattgtatggctcttggcctggtctgatgattgggcgcgggcaagctgtttttggagcacatgtatctgtttggtgacatcttcaaggatggtctctacatgatatggctgcgcgtaggccgctggagcttcttcttccgttttttctttttgttttgtgccgccatcaatatcagcaaaatgagaagcaatccaggcatcgctttcatcaagctgccgtttatacgatataatagtttcgtgaaataatttttctttcgttttttctatgtctagcagtctttctttcgtttctatgattcgatctttcatatgatcaacttctattttaatatgttttagctgatattctttttctaccatttgctcttttagacgcccgttttcggcttttatcaattcggcttgctgttttgcctgaagcagtgcattttgttcctgctcaatcgaggcttgaagttcgctgatccgtttatgaagatttttattttcttcttcgattttgactttagcaatatgaagtttatgtttttcttcgatttcggctctgcgtttataggtttcagcagatagaagctcctgcaaaacaacgattttatcaagcagttcagctcttatttggtgcagggtttggctggtgtgggaggcatgtttttcttttgttgacatatgtgttaattcggcagacagctgctggagtttttctttcatatcggtattttctttgagcagtttgttatttttctgatgaaagtagcttgcttcaagttcagaaatcagcttatggcaccttgaaagctcggattttaaataaaggttctcctgagacacgtcgtggaaaaaaggacctgatcttttcattcgaaccatctccctcatgatgttaacactacaatatgcaaatactgaacagctattcctctttaataaacagacaagcagtagcgttgagcctttgcttttgctatgcttttaacgaaactagaggtgagatgatatgaagcatgtaaacgtactgctggcagggggagcctcacgtcgctttggagaaccgaaggcgtttgtcaaatggaagggcaggatgctttacgaatgcgctaaagaggcacttggagaacaaacggttatcatcagccgtcccgaatttattgatagatttcaagaaaacggtgaaaatgaagtgtatcaagatgctgagccatttcaaggcatggggccattggctggtatatataccgcttttaaaaagacagacggtgatctttatactgttctttcctgtgacacaccgctgatacaaagaaggacgatgctggagctcaaatgtctgatgactgccggtgcggacgcggtagtcccaatttcagacggacaagtgcagccattgattgcgatttaccacaaacgtatcatgccagttctatacgatcagctttctgagaagaggttgagaatatcagatttattaggcagaatttcggtttgttacgtacaggctgaaaatatcggagcaaacccggcagagtttatcaacattaatacacgtgatgattttagctgtttggaagaaaaatcgaactccctcaagcgggactgacggggcaataacatgataagatgacataaaagataaggagaacaggtttgatggaggaacgttattcacggcaaatcagatttaagcaaattggggaagagggccagaaaagactggcagacagccatgtgctgattgtcggagcgggagcgctcggcactgcaggagctgaagggctttcgagagcgggagtcggtactattaccattattgaccgtgactatgtggagtggagcaatcttcaaaggcagcagctttatacagaaagcgatgccaaactccgcatgccgaaagccatggctgctaaagagcatctatcagcgattaacagcgagatacatattgaggcgtatgttaccgaaggaacagccgaaacgcttgagccgctgattgaaaaagcagatgtcgtgatcgacgcgacagataattttgaaacccgcatgctgataaacgatcttgcccagaaaacaaagacaccttgggtctatggcgcctgtgtaagcagccagggaatgttcatgactgtcattcccggagaaaccccttgtctgtcttgtttgtttgagcaaattcctgtcggcggggcgacgtgtgatactgccggcattattccgcctgctgtgcatatcgtttcagcatatcagcaggctgaggcattaaagctgttaaccggccaaaaagaagcaatacagcggggttttgtgacatttgatgtctggaacaattcgcatatgaagataaacgttaatcatgtacgccgtgaggaatgcccatcttgcggagctaatgcggtatatccttatcttcaggattggaacacaccaaaagctgctgtactatgcggccgtgacacagtgcaggtaaggtcagaatcattaaaaagaatcccgaaacaggagctcattaagcggctgaaaacaatcggcaaggtcgaggctaatgcgtttttgctgcatattttttacgaggatttcagaattgtcattttcagtgacggacgggcactggtgcatggaacaaatgatgtgaaagaagccaactccgtgttggcaagagtgattggactgtaacaacaggaggggtcagaatgctggagaaaagaacaccgataccggtagacgaggcagttcggcgtgtctgccattttcaaaaacaaggtgaaacagaatgggtggcgcttgaagacagccttcatcggtttttagccgaagatataactgcggatcaccacgtccctgcgtttgatcgttcgccatacgatggttttgctgtcagagcgtgcgatacggcagaagcttcacgtgaaaacccagttcggtttgaagttattgaccatattggagcaggagcagtatctgaaaaagaacttggcccgtttcaggccgtacggattatgactggcgcgcaaatccctgaaggggcagatgcagtcgtcatgattgaactgactcaaacctttgaggagaatgggaagtcatttatgtctttaaaacgccgctttcagacggggataatatttcaaaaacaggtgaggacgctcaaaaagggagtgttttactgacaaagggcacccgggtgacaccaggagtgacggctcttttggcaacattcggatacgcatctgtgcctgtcgtgagaaagcctgtagtcgggattatcgcaaccggtaccgaattgctgaatgtcagtgatccgctggaaccgggaaaaatccgcaacagcaatgcgagtatggtatatgcgcaagcgatagaagcaggcgcaacaccgctttatttagggaaaatctctgatgaattggataaaagctttgctgcagttaaagaagcgatgaaaaaggtggacttcctgatcacaactggcggtgtgtcagtcggtgactttgactttttgcctgcgatctatgaaaaactcggagcggacgtgctgtttaataaagttgccatgcgcccgggcagcgtgacaacggtggcgcatgcaaacgatatgctgatgtttggcctttcaggtaatccgtcggcatgctatgtcggttttgaactgtttgtcaaaccgataatccagacatggctgctcaatgaaacaccgcattcaatttgtgcggaagctgttttgaccaaggattttccgaagccgaacccatttacccgatttgttcgtgcgctcgtgcaccatcaggaagggaagctgttggcgacacccgtcggattagataagtcgagctctgtcacatcacttgcagatgccaatgcatttattatcctgccgggcggcacgcgaggctacgaaactggcagaacggttcaagtgctgctcattagagaagagaatggaagtgaatggccttggtccgtcctttcccgatcgtccaagttgtaggatttcaaaacagcgggaaaacaacgtttattgagcgcattcttgaaaaagcctctgaacaaggagtctatttgggctgcctgaagcatcatggtcacggcggtgaaccgcaagcgctcacggaaggaaaagacacggaccgttacaaggcggcaggtgctgatgtaacagcggtagaaggtgctggtgtgttacagctgactgcccgccgcaattgggatttggcacggctgatcgagttataccaatttctcgaaacagactgtcttctgattgaaggctttaaaaaagccccttatcctaaagtggttatcctaagtgaaaaggaagatctggaagcgctgcaagcagtaaatataatcgccatcatctatagaaaaaaagagcatatgacagagcatcagggattacccgtttttcatgcggatgatccggttgccgtggattttgtgctttcacagctgaagggggaatctgcataatggaacggtttgagattacgaaaacacccattaatactgaagacatcattaaaaaagtagagaaacgggaagcaggggcaattacgacatttatcggtacggttcgggaatggacaaacggaaaaagaacggttcggcttgaatatgaggcatatgaaccgatggccgtgcaaatgcttgctcaaatcggcgctgaaatcgaagaaaaatgggaaggtgcctcagctgcgatcacgcaccgtataggtgtgctcgatatcggtgaagcagcggtggtgattgctgtatcttctccccatcgaaaagccgcatatgaagccaatgagtatgcgattgaacgcattaaacagattgtgccgatttggaaaaaagaaatttgggaagacggtgagcaatggatcggcgaccagctagaaacaacagcttatccgaacggaaaaccagatctaagcgagggagaccagcatgattaaaattcttttatttgcaggactggctgaacaggccggtacacaagcaatagaaatagatgtggaacaagcaaccacagatgaaataaaagcgagtctaaaagaacaatacggtcttgaatctattgatacggctatgattgccgttaacgaaagctatgtaaaagaaaatacctctgtatcttcgggtgacacggtagccatcataccgccggtcagcgggggatgaaaaccggacggcatttcagccgtccggtttttctgtatttcattggcatatccccaagtatccccagcatacaatgattttctgtaagcgtttattctacatatgttactccctataaagtaagagactcactccataattagactgaaattttgaaaaataatagaaatttatttcgggtatcgatatagtgaagataataaatgttggaaaggtgctggatatggagacatttaaaagattaaaaatatattattggccgtacagaaaagtgtttatgtggtcgcttctagccatgcttttgatgactgcaattactgtcgtttatccgattatcctgcaaattacgattgatgagatcgtgctgggacggcagtatcagcttgcggcgtgggtcagcttaggatttattgcggtaatggttttgaaaggaatggctaccttttttcatcagtatttaggtgatatgttcgggatcaaatccgtttatcggctgagaaatggtctgtatgaaaaactgcagcggctttctttttcttactatgataacgcgaaaacaggagatttgatgtccaggctgactgctgatgttgaagggcttcgttttttcttatcatacggtctcgctgagctcattcggttcggcctgctggtagccatcagcctgtcggttatgttttactattctgttcctctcacgcttgtgacaatagctgttctgccatttctcgcggttgcggtataccggtttgacaaaagagtccatcccgccttcagaggcatccgcaaatcgtttgcgaaactcaatacaaaagttcaggaaaatatcagcggcattaatacggttaaatctctttccagggaagattttcagatcagcactttcaataaagccaatgcagaatacagggcgcagtatttacaaacatcatccatctggtctgcgtatttccctttaatggagttcattggtaacatttgtattgtagctctcctctcatacggcggttacttggttatgcaaaatcagctcaatcccggcgagcttgttgctttcttcagccttgtcaattatatgatgtggcccattatgaacttaggttttgtcatcaatatgttctctcaagcaaaagcgtcaggggaacgcctgctcgacattctggaaaaagaagaagacattacagatcatcctcatgctttgcataaacaaaaattaaccggagatgtccatttcaaaaatgtttctcttgcatacgggaaagaacaaataaacgcgctgtgcaatgtaagctttgaggcaaacagcgggaaggtaatcggactgttgggcccgacaggttcaggcaaaagctcagtgacacagcttctcaccagattttacagtcctgttggcggaatgattaccattgatcacaaacccatcacagattattcgttaaaaacccttcgttccaatatcggggtcgtacttcaagaatccttcctgttttcatctacgattagatcaaatatttcgtatgggcggccggatgcctcaatggaagacgtcatcgaagcggcaaaaagggcacaggctcataactttattatggagcttcctgatgggtatgacaccatgctgggagagaggggaatggggctttccggcggacagaaacagcgtattgccattgcgagagccatctgcttgaacccgagcattttaatattggatgatgccacaagcgcagtagatatgcaaacggagcacagcatacagcttgccttaaaagaagtcatgaaaaaccgcacaacctttatcgtcgctcaccgcatttcttcactgaaacacgccgatgaaattctcgtttttaataaaggacgcattcgtgaaaggggaacacatcatgagcttcttgaaaaaggcggctactataaaaagatttacgatttgcaataccgtgatgtcaaaatgattaatgagccgcatgaggtcggatagggaggggccaaatgaaacaagcgaaaaaacaggggattttagagcgtttctattactcttcagatgaaatcattgaaaagccgtttaactgggctcaaatgtggcggctgctgagctatgtcaaaccatatcgaaaaacaattttgccgctttcttttctcaccgtattaattggcactgctgtgaagcttgtgatccccattttgatcggcgtttatgttcttgatcaagcgattacagggagaaactcggagctgctgattcagctcatttttattattagcggtttatatgtcctcaattacgccgccaatgtgttaagaatcaggtggatgaatcagcttggccagcatgtcatttacgatttgcgacagcatttatttacccatgtgcagcgcttatcccatcgattttttgatcagcggtcggcgggatcgatcttagtcaggatcatgaatgatattaactctcttcaggagctctttacaagcggagtcatcaatttgttgaccgacttgctgcttctggccggcgtgattatcattttgtttacgctgagccctgagctgactatagccatcatggtgacattgccgattatgttttttatttcaacaagtctcagaaaaaaaatacgccgatcctggcaaacggtacggctgaagcaatcgaagctcaactctcatctaaacgaaagcattcagggcatccgggtcacacaggcatttacgcaggaagaagaaaacatggcgtattttgacggtgtcaatcaggagaactatgaatcatggcgggaagcaactagaaaaaatgccatgttccgtccgctggtagaaatgacgaatgcgattgggacggctgtcttgatttggtatggagccacactcatcatgaatgaaaccattacgattggcgtcttcgtttcttttgctttctatctgggaatgttttgggaacctatttcgagactgggtcaggtctataatcagctgttaatggggatggcatcatcagaacggatttttgagtttctggacgaacagccaaatgtcaaggagaagccgaatgccattcataatgaaaagataaatggggagatcagttttgaagaggttgaattttcgtatgatgaaaaacgaaaagccctttacgccgtttctttctctattccggcgggctcgacgcttgcgcttgtcgggcatacagggagcgggaagacgacgattgccaatttaatcagccgtttttatgatgcgaccggaggcaccattaaaatagacggtataccgattaaggatctttcccttgccagtctgcgctctcaaatcagcattgtcctgcaagatacatttattttctctgggaccatcatggaaaatattcgttttggaaggccaaatgcttcggatgaagaggtgatgaaagcgtcccaagcggtcggagcggatgagtttatttccgatttagcggaaggatacgcaacagaggtagaggaaaggggcagcgtactgtctgccggtcagcgtcagctcatttcatttgcaagagcattgctcgccgatccggctattatcatccttgacgaagcaacggcaagcattgatacagagacagaagtaaaaattcagcaagcgttaaaaacgcttctgaaagggcgtacagcagtgatgatcgctcacagattgtctacgatccgcgacgccgaccgcatcattgttcttgatcacggcaggaaaatagaagaagggaaccatgatcagctgctcgctaaaggaggcatttatgccgggcttgtgaaagcgcaatacagcacagcgatagaataatatgaaaagccttcaatattgaaggcttttggaaatttattagaaaaacatgaaactttttgatatccttcccgtactatttgttagatattctcaaggaggttttgaaatggaaacgaatgtagaaaaaaacagcggaacggcgactgaaaagccttcacttttcggagtaatcacaagtccgtccgttcaatttgaaagaataagagaaaggccggctgtatggggaccgcttttgattgttgcagcaattatcatcgtcggtgccgtactgcaatcactcggtacggattatagtgagcttttgaaaagccaggatacgcaagggctatctgctgaacaaatggaaactttcgcaacaataaccaaagttggcggaatggtaggcgctattatcggcggtatcgcagcattatttattgcccctcttatttattggctctgtgtaaaagtatcaggcggtgttacgacatataaaaaaatgctttctctcggtctgtttgtcactttgattagcagtctcggattattggttaatggaatcgttgcttttacgactgacgtgaatcctctttacagcacgacgtcactggcagggattatcccatctgacggggctctcgccagtgtgttaaatacctttgaaattttcagcatctggagctttgtattattagcaatcggacttcacaaaacgggaggcatctccaaaaaagccgggtggatttcagcaattattctattcggaattttagttgtattttcgcttttttcaggtttaatcaattctgtggcgggtgcataagctcatgaaaaaagtctggatcggaattggaatcgcagttatagtcgctctttttgttggaatcaatatataccggtctgccgctccgacaagcggcagcgccggcaaggagatacagacggggagcgttgaagaaaatgaaatctcatcaacggttatggttcctggcacgctaaaattttcaaatgaacagtatgtcttttatgaagtggataaagggacattagaagacattaaagttaaggcaggcgataaagttaaaaagggcacgcctttagtcacctatacaaatgagcagctgagcctggaaaaagaacagaaccagttaacgtctgaatccaaccggcttcaaattgaccaaattcaagaaaagttaaaagccttagacagcaaagaaagagaactggaaaaacaggtaggaaagaaagaagcagaaaaacaaatcgaatctgaacggacagagcttcaaatgcagaaaaaaacagcggagatcgaattaaaacaaactgagcttcagcgacagtcacttgccaaccgggtatcagatcttgaagtgaaaagcgaaattgaaggcaccgtaatttcggtcaaccaagaagcggcatccaaaaagtcagatattcaagagcctgtcatacatatcggcaacccaaaagaccttgtcgtctcagggaaattgtctgaatacgatacattgaaagtcaaaaaaggccagaaggtcacactcacttcagatgtaatacagggtaaaacatggaaaggtacggtttccgcagtcgggcttgttccggatcagcaggagagcgctgcggcacaaggaacagaacaggcggtccaatacccgcttcaagtgaaaataaaaggaaatcttccagaaggaaagcctggctttaaatttatcatgaatattgaaacagataaacggaaagcaaatacgcttccttcaaaggcagtcaaaaaagaagatgaccaatattatgtgtatacagtaaaagacggaaaagcaaagcgagttgatgtcaaaatcggcgaagtgacagatgacctgacagaaattaaagaggggcttatccaagatgatcaagtcattttgaatccatctgatcaggtgactgacggaatggaagtgaaatcctaaatgattcagctttctaatgtgcgaaaaagctaccagatcggaaaggaaacgtttgatgttctccattctattgatttggacattcatcaaggtgaatatgtctcgattatggggccgtcaggatcaggaaaatcgacgatcatgaatattatcggctgtcttgatcggccgacttccggtacatatcaattggacggcgaagacatatcttcatataaagataaagaactggcggcagtccgtaaccggtccatcggttttgtatttcagcaatttcagcttcttccgcggctgaacgcaaaaaaaaatgtcgagctgccgatgatttattccgggataggcaaaaaggaacgtcaagagcgggctgagagagcattggaaaaggtcgggttagcagatcgaatgctccacatgcccaacgagctgtcgggcgggcagaagcagcgggtggcgattgcgagggcgatcgtgaatgagccaaaattgattttagctgatgaaccgaccggcgcgctggatacgaaaacaagcgaggcgattatggatcagtttacagcattaaatgccgagggaacgacaatcgttctggttactcacgagcctgaagtagcagattgcacgaatcggatcgtcatggtgcgtgacggaaacattgttcctgccagctccggacaaaggagtgtgggagaatgagcctgttagaaaacatcagaatggctctaagctctgtccttgcccataaaatgcgttcgatcttaacgatgctcggcattatcattggtgtaggctctgtcattgttgtcgttgcggtaggacagggcggcgagcaaatgctgaagcagtcgatcagcggcccgggaaatactgtggagctgtactatatgcctagcgacgaggagcttgcaagcaacccgaacactgcagctgaatctacgtttacagaaaacgatattaaaggtttaaaaggaatagaaggcattaaacaagtcgttgcttcgacttctgaaagtatgaaagcgcgttatcacgaagaagaaaccgatgctacggttaacgggataaatgatggatacatgaatgtcaattctttagaaatcgaaagcggcagaacatttaccgacaatgactttctcgcggggaatagagccggaatcatctctcaaaagatggctgaagaactgttcgatagaacctcccctttaggtgaagttgtctggataaacggacagcccgttgaaattatcggtgtgctgaaaaaagaaacaggcttgctttctttcggtttaagtgaaatgtatgtgccatttaatatgatgaaatcctcttttggcacaagtgatttcagtaacgtatcattgcaggtcgaatcagcagacgacataaaatcggcaggaaaagaagcagcacagctggtaaatgacaatcatggcacagaggattcgtatcaagtgatgaacatggaggagattgcggctggaattggcaaggtaacggcaattatgacgacgattatcggctcaattgcaggtatttcccttttggtcggcggaatcggtgtcatgaatatcatgctcgtatcagtcacagaacggacacgggaaattggaatcagaaaatccctcggtgcgacgaggggacagattctgactcagtttttaattgagtcagtcgtattgacgctgattggcggtctggtcgggattggtattggatacggaggggccgcgcttgtttcagccattgcgggctggccgtcactcatatcctggcaggttgtatgcgggggcgtgctgttcagtatgctcattggtgttattttcggcatgcttcctgcaaataaagctgcaaagcttgatcccattgaagcgctgcgttatgagtagcctcatgcaacatgcatgaggtttttttatgtttagtgatttctactatgaatataaaagacttttttcattaaaataagaagaaaatgtcgtacaattgtccttatttttgtcgaatttacagtttacaaaccctatagacatacgttaatatggagaaacgtgaaagattttgatagttattgaatgaatttgaatgattttagttgcctaaaccgaaaatagcgtttacaatgaaattgtattcaaaatgaatacgttttcattaggaggtgaagcatgctaactcctgaacggcatcaattgattattgatcaaatagaaaagcatgatgtggtaaagattcaagagcttataaatctgactaatgcttctgaatcaacaatcagaagagatttatcgacacttgaagaacgcggttttttaaagcgcgttcatggtggagcggccaagctttccgatatcagacttgaacccgatatgcttgaaaaatcatccaaaaaccttcacgataaattgaagattgctgaaaaagcagcttctcttttagaagaaggggattgcatttaccttgatgcaggcacgacgacattgcacatgattgattttatggataaaaccaaagatattgtcgttgtcacaaacggggtgatgcatatcgatgcattaataaggaaagaaatttctttttatctgcttggaggatacgtaaagcacagaacgggcgcgattattggaggcgcttcattgattgccatggaccagtacagatttgacaagagttttctggggacaaacggtgtccatacagaggctggatttacaacgccggaccctgatgaggcccttttaaaacagaaagcgatcaaacaggcaaaacacgcttacgtcttagcagacccttcgaagttcggagaaatttcattttcggcattcgccggaataggcgacgcaacaatcattacgactgacgctgaagagcttacattcgataattaccaagaaaaaactgtcgtaaaggtagtgaaaccatgatttacactgtaacacttaatccatctgtcgattatattgttcacgttgaagattttactgtaggaggcctgaaccgttcttcgtatgataccaagtatccagggggcaaaggcatcaacgtatcgagactgctgaaaagacaccatgtggcgtctaaagcgctcggattcgtcggcggatttaccggagaatatatcaaaacatttttacgggaagaaaacctggaaacagctttttctgaagtaaaaggggatacccgtatcaatgtaaagctgaaaactggtgatgaaactgaaattaacgggcagggaccgacaatttcggatgaagatttccaagcctttttagaacagttccaatctttgcaagagggagatatcgtcgttcttgcaggaagcattccatcttcactccctcacgatacttatgaaaaaatcgcagaggcctgcaaacagcagaacgcacgagttgttctggatatctcaggcgaggctcttttgaaagcaacagaaatgaaaccatttttgatgaagccaaatcatcatgagcttggagaaatgttcggcacggccattacatctgttgaggaagccgttccttatgggaaaaagcttgtagaacaaggcgctgaacatgtaattgtatcaatggccggagacggagcgcttctgtttacgaacgaagctgtttattttgctaacgtgccaaaggggaaattggtaaactcagtcggagcaggggattccgttgttgcaggtttccttgccggaatttccaaacagctgccgcttgaagaagcattccgcttaggagttacttcaggcagtgctaccgcgttctctgaagaacttggaacagaagaatttgtccagcagcttcttcctgaagttaaggtcacacgtctatagaggaggaaacacaagtgaaaataactgagcttttaacgaagcatacgataaagcttaatattgagagcaaagaaaaagaaaatgttattgacgaaatggtcactgttcttgataaggctggaaagttaaatgaccgacaagcctataaagaagccattttaaatcgcgaaagccaaagctccacgggtatcggtgaaggaatcgctatccccatgcgaaaacggcaagcgttatcaacccggcgatcgcgttcggacgttcaaaagacggcgtcgattatgaatcattagacggccagccggctcacttagtgttcatgatcgcggcgactgaaggcgcaaacaacactcaccttgaagcattgtcaagactttcaacgctgttaatgcgtgaagaaatccgtaagcagctccttgaagctgagtctgaagatgccatcatcgacattattaatcagcacgataaagatgatgacgaagaggaagaagaagaagcggcaccagcacctgccggaaaaggaaaaattttagcggttactgcatgtccgacaggtattgcccatacattcatggctgcggatgcccttaaagaaaaagcgaaagagcttggagtggaaattaaggtcgaaacaaatgggtcaagcggcattaagcacaagctcactgcccaagaaatcgaagatgcccctgcaatcattgtcgcagcggacaagcaggttgaaatggaacgttttaaaggcaagcgcgtacttcaagttcctgtaacggcgggtatcagacgtccgcaagagcttatcgaaaaagcgatgaatcaagatgcgccgatttatcaaggcagcggcggcggttcagcagcttcaaacgatgatgaagaagcgagaggcaagtctggaagcggtatcggaaacgcgttttataagcacctgatgagcggtgtcagcaacatgcttccgttcgtagtcggcggcggtattctcgttgcgatttcattcttctggggaattcactctgctgatccgaatgatcctagctacaacacgtttgcagcagcattaaactttatcggcggcgacaatgcattaaaactcattgttgcagttctggccggtttcattgcgatgagtattgcagatcgtcctggttttgcgcctggtatggtcggcggttttatggctactcaagcgaatgctggattcttaggcggcttaattgccgggttccttgccggttatgtcgtgattttactgaaaaaagtatttacgtttatccctcagtcacttgatggattaaaacctgttttgatttacccgctgttcggtatttttatcactggcgtattaatgcaatttgtcgtcaatacacctgtagcggcatttatgaatttcttaacaaactggcttgaaagccttggtactggaaatcttgtgttaatgggtattatcttgggcggcatgatggcgatcgatatgggtggcccgcttaataaagcagcctttacgttcggtatcgccatgatcgatgcaggcaactatgcgcctcatgcagcaatcatggccggcggtatggttcctccgcttggtatcgcacttgcaacaaccattttcagaaacaaattcactcagcgtgaccgtgaagctggtattacatgctatttcatgggagctgctttcgtaacagagggagcgatcccatttgctgcggctgatccgcttcgcgtcataccagctgctgtagtcggtgcagctgttgccggcggattaactgaattcttccgagtaacgcttccggcgcctcatggaggagtattcgtagctttcattacaaaccatccgatgctttaccttttaagtatcgtgatcggtgctgtcgtgatggcaattatcctcggtatcgtcaaaaaacctgttacagaaaaataagaaaaaaagcgtccttggttcgaaaggacgctttttcttatccggccggcagggagcgcggttaagttatgtattttattcttttttatgataaagtaaaagaagagaaacaactgacatagcaattgtctaggaggaaacactttgaccgaggaaaaaaatacgaatactgagaaaacggcgaagaaaaaaaccaatacgtacctggaatggggtaaagcgattgtcatcgctgttctgctggctctcctgatccgtcactttttgtttgaaccgtatttagttgaaggttcatctatgtatcccacattacatgacggagaaaggctgtttgtgaataaaacagtcaactatatcggcgagctgaagcgcggagatatcgttattatcaacggtgaaacttctaaaatccattatgtaaaaagattgatcggaaagcctggagaaaccgttcaaatgaaggatgacacgctttatataaacggtaaaaaagtagccgagccttacttgtctaaaaacaagaaggaagcagaaaaacttggtgtcagtctgacaggagactttggaccggttaaggttccgaaaggcaaatactttgtcatgggagataaccggctaaattctatggacagccgaaacgggctgggactgatcgcggaagatcgaattgtcggcacatcgaagtttgtctttttcccgtttaacgaaatgcgtcaaacaaaataaaaacgccttgctggcctaggacagcaggcgtttttattttgaaaaagaagcgaccaatgcaatgcataaaaccgtgatgaacactgaaccgataatagctagcacactgaagaaaaggtgaacctgtttgttctcttttccgcgcttttctaaaagccgtttagaaaaaatgtgtgaaaatatgtaaataagggctatgcctatatataagccaatatctttggcggtaaagcctgttacggcaaggtaaaagcccgtaaaaaagatcagtaagcaatattcagtaagtgttaaaagcctcaacgtgttcctccatgagagtgtgtaattttccgagcggatgcattctctctctttaattgtaacacagctggctggtttgggtgtataagtgttttctctctgttttatcagggaatcatttctcttgccctgcattcatggtatacttttattgatgatagacatgatggaggataataaatgattgctgtaaataatgtaagcttgcggtttgcggatcgcaagttatttgaagatgttaatattaaatttaccccaggcaactgctatgggttaattggtgcaaacggtgccggtaaatcaacgtttctaaaggtgctgtcaggtgaaatcgagcctcagacaggcgacgtgcatatgagtcctggcgagcgtcttgccgtcttgaagcagaaccattttgagtacgaagagtatgaagtgctgaaagtggtcattatgggccacaaacgcctgtatgaagtcatgcaggagaaagatgctatttacatgaagcctgatttctcagatgaggatgggattcgtgctgctgagctagaaggtgaatttgcggaactgaacggttgggaagcggaaagtgaagctgcgatcctgttaaaaggccttggtatctcagaagatctgcacacaaaaaagatggcagacctcggcggttcggagaaggtaaaagttctcttggcgcaggcattattcggcaagccggatgttctgctcctcgatgagccgacgaaccacttggaccttcaggcaatccagtggcttgaagagtttctgattaactttgaaaacacagttattgtcgtatcccatgaccgtcacttcttaaataaagtatgtacgcacattgccgaccttgattttaacaaaattcaaatctatgtcggaaactatgatttctggtacgagtcaagccaactggcgttaaagctttctcaagaagcgaacaagaaaaaagaagagcagattaaacagcttcaagagtttgtcgctagattcagcgccaatgcgtctaaatctaagcaggctacatcaagaaagaaacttctcgaaaaaatcacgctggatgatattaaaccgtcttcccgccgctatccttatgttaacttcacgccggaacgggaaatcggaaatgatgttcttcgcgtggaaggcttaacaaaaacaatcgatggcgtaaaggtgcttgacaatgtcagctttattatgaatcgagaagataaaattgctttcactggccgaaacgaacttgctgttactacgctgtttaaaatcatttccggggaaatggaagctgacagcggaacgtttaaatggggtgttaccacatctcaggcgtattttccaaaagacaacagcgaatatttcgaaggcagtgatctgaaccttgtagactggcttcgccaatattctccgcacgaccaaagtgagagctttttacgcggcttcttaggacgcatgctgttctctggagaggaagtccacaaaaaagcaaacgtactctccggggagaaaaggtccgctgtatgctgtcgaaagcgatgctttctggcgccaatattttaattttggatgagccaactaaccatttagacctagagtccattacagcgctcaataacggcttaatcagctttaaaggcgctatgctgtttacttcccatgaccatcagtttgtgcagaccattgccaacagaattatagaaattacacctaacggcatcgtcgataagcaaatgagctatgatgagttccttgaaaatgctgatgtgcagaaaaaattgactgaactatacgcggaataaaaaaagcagagatttctctgctttttttgatacctaaatatgaaaggagatcacaacatgaaatttttggttgtcggagcaggtggagtaggtgggtatattggcggacggctttcggagaaaggaaatgatgtgacatttctcgtgcgccaaaaacgagctgagcagctgaaaaaaaccgggcttgtcatccatagtgaaaaagggaatgtatcatttcagcccgaactaatcagtgccggagaaacagggcaatttgatgtcgttatcattgcttctaaagcatactcgcttggtcaagtgatagacgatgtcaaaccatttatccatcaggaatctgtcattatcccttttttaaatgggtaccgccactatgagcagctatttgcggcattttcaaaagtacaggtgctgggcggcctgtgttttatagaaagtgctttagacaacaaaggagaaattcatcatacgagcgcatcacatcgttttgtatttggagaatggaacggcgagcgtacggagcggataagagcgcttgaagaggtattttcaggtgtgaaggctgaagtcatcattagcgggcatatcgagaaggacatttggaaaaagtatctctttattgcagcgcaagcggggatcacaacgttatttcaacgaccgcttggcccaatcctcgccacagaagccggacgtcacacggcccaaactcttattggggaaatttgcgccgttttacgaaaagaaggtgttccggctgatccggatcttgaggaagagagctttcgtacgatgaccagcatgtcttatcatatgaagtcctccatgcttcgggatatggaaaacggccaaacgacagaaggcgaccacctgcatggatttttgcttgaaaaagctaaacgtttatctctcgctgcaccagtattagaaaccgtttatgcgaatctgcaaatgtatgaagcagaaaaataaaaaaaggaggcggaaaagcctccttttatttacttaaaaagcccaatttccgtttctgaagataggctctcttttcccgtctgccgtaattccgtcaatattcatatccttagaaccgatcataaagtccacgtgtgtaatgctttcatttaggccttctttgacaagctcttcacgagacatctgctttccgccttcaatattaaaggcataggcgcttccgatcgccaaatgatttgacgcgttttcatcaaacagcgtgttatagaaaagaatgtttgattgtgatataggtgaatcgtaaggaacaagtgccacttcacctaaatagtgagaaccttcatctgtttccaccagttcttttaaaatatcctcacctttttcagctttaatgtcgactatacggccattttcaaacgtcagggtgaaattttcaataatatttccgccgtagcttaatggttttgtgcttgataccacaccgtcaaccccgtctttttgcggcagcgtgaacacttcttctgtcggcatattggccataaactcatggccgctttcattcacgcttcccgcacctgcccaaacatgcttcctaggcagcttaattgttaaatcagttccttcagcttgataatgtaaggcagcgtaatgtctctcgttcaaatggtcaactttttcatgaagattttggtcatgattgatccacgcctgaaccgggttgtcttcatttacgcgcgtcgctttaaaaatttcttcccacagaaggtggatcgcttcctcctctgatttgccaggaaacaccttgtgagcccagcctgctgatgccgcacctacgacagtccagctgactttgtctgattgaatatattgtctgtatgtatgtaatgctttgcctgctgctttttggaatgccgcaatccgtttggaatctataccttttagcaagtctgggtttgacgacacaacagaaatgaaagcagctccatttttggcaagctcttctctgccttttgcttcccattcaggatattcttcaaatgcttcaaacggcgcaagttcgtattttaatttggcgacttcgtcatcctgccaattcacggtgacgttttttgcgcccttttcatatgcgtgttttacaattaaacggacaaaatcccgaacgtctgttgaagcatttacgactacatactggcctttttggacattaacgccgacttctaccgccagctgtgcatatgtatttaatttctgtgaaaatgaatccatgaatcattcctccaagcttttttctcatcatatcaaatatgatcctataaaggaaagaaggagcccaaagtgaaaaacccaaaacgacacgtcttgggtttttcaatattatggatgattcagttttacagtgccgcctgcaggcgaatgaggcatatttgccaaagaaatgctcatgcctccaagaataattccgcttaaaatggctgcgatcgctactcttcttcctaaatctcttagcatctgtttcctccttaacgtttctccatttcccacaatatgaaggaagtgaggaaaaaagaagcaagaaatttgccgcgtgtgagaattttgcggggaaagactatttaattgccttttgcagcttatcaatcacttctaaagaacggcctgtgccgattgctacagattcaagcgggttttgcgccacgtggacaggcacgacaatctcttctgtgagccattctttaattccattaaggagcgcgccgccgcctgttaaaataacgccgcgatcaacaatatctccgctcaattcaggcggacagtcctcaagtgtcgctctgatggcttcaagaatatgcaggagggattcacgcattgcatcttgaatttcgttggattgaagcataatggtttttggaagacctgtcacgaggtcacgtccccgaatttccattgcctctggtatatgttcaatcagagcatggccaatttccatttttacctgctcagctgtgcgttcgccgatcagcaaattgtattttttacggacgaaagaaacgatatcctcatcaagctggtctccgccgatcctgatagaatggcaggaaacaacgccaccgaaggaaataatagcgacctctgtcgtccctccgccgatgtctactaccacattggcaaccggctcatcaaccggtaaatccgctccgatggcggctgcaactggctcttcgattaaatgaacgtttttcgcgccgcaatttttcaccgcatcactgatggcgcggcgttctactgctgttgagcc
